United States Patent 7,745,391 (HUMAN THROMBOSPONDIN POLYPEPTIDE) - sequence listing, part 166

SEQ ID NO: 424410 - DNA, 1915 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtagcgtgaccgcggggccgtaggtggcctgcggcggggtgggcggggcctgcacatccagctccttcccccacaggtacgtccagtgtgcccgagccgcgggcgtcccctgccgctgcttcctcttcaccgccactctggagcaggcgcgccacaacaaccgggtgagcccgctcagcccggacaccccccgggctgcaccccctgacccccctcctcccctgacccctgggcctgccgcccctctgatgttccccacagtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424411 - DNA, 1980 bp, Homo sapiens
ggggacgagtcatttcaatcggccgagggaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggtatgaccaggcttttgccgccccaaatctattataaagttcccatctccacctctcaactggtttggggcggctttcctccatcattgcctccccgtccccgctcggggtcttctctccccctgggtctgccgatctgtttgtgacctctcgtgtccccaggacacgctaggctcctggcagcgctgtgtgaccacgtgtgagacagccctgaagcaagggaaacgggtcgccatcgacaacacaaacccagacgccgcgagccgcgccaggtagcgtgaccgcggggccgtaggtggcctgcggcggggtgggcggggcctgcacatccagctccttcccccacaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424412 - DNA, 1531 bp, Homo sapiens
ggtggggcctaagggtctgatagtggtggagaagggctgatttttccgctgggtatttgattggaggaagctcccggtgggggcggagccagtcccagctcctccctctctttctgcagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 424413 - DNA, 188 bp, Homo sapiens
agcagctgcagaaggccctgagacagccccacagtcctttgcctccaggaaagacctcccgccaccaggctctaggaacaatcctagactttctacctaatttgtactagcttattccagagtcgtatagcctaacagctgggaagagcctcctgagtttctcctgctaatatacactgtcatttggt

SEQ ID NO: 424414 - DNA, 579 bp, Homo sapiens
  misc_feature (6)..(6): n is a, c, g, or t
gttacnattatccgctcctatgggatttgcctcgggccaagattcgcacgagctgaaaggccatatgcgtgtgaggtatgtgggaaattatttggtaataagaactgcgtgactatacatcagaggattcacactggagaaaggccgtatgaattgcagtgaatatgggaaatcgtttgctgaaacatcccgtctcgttaaacacaggagagttcatactggagaaaggacttatgagtgctgtcaatctgggaaacatcagaatgtctgctctccttggtcttaagagacttcgcattggaacggagtctcattctgtcacccactgcactctagcctgggcaaaagagcaaggccctgcctcaaaaaaaacaaaacttttttcttcataaactacagtttatataggcaaaactttcagtactaagcaattttagtctctgcaggctcttgtcttgaattaatacaacttttgttaattctcttatgaagttaaatcttcctgcttgtatgcaacttatatgttgaaatttttttgtacaaaagattcatacatctttcctgtttgaaattatttta

SEQ ID NO: 424415 - DNA, 821 bp, Homo sapiens
gcagtggtgcaatcttggctcactgcaacttgggcctcccaggttcaagtgattccccctcagcctcctaaagtgctgggattacaggcatctgccacggcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatttttcatccttctcactggaaagatctttgatgatttttaatcaacataggagtttcaatgatatctagaagtttaaaagggctcgttcaaacaaattatgaccatacaccctgaagagtatgtgtctgtctcttgtggtgtaaatttttattttattacacccaattatgttcccacaaaacctttataattgggaaattaaggagccttccttggaaatggaggttgcaatcagctgagatggtaccactgcactctagcctgggcaaaagagcaaggccctgcctcaaaaaaaacaaaacttttttcttcataaactacagtttatataggcaaaactttcagtactaagcaattttagtctctgcaggctcttgtcttgaattaatacaacttttgttaattctcttatgaagttaaatcttcctgcttgtatgcaacttatatgttgaaatttttttgtacaaaagattcatacatctttcctgtttgaaattatttta

SEQ ID NO: 424416 - DNA, 836 bp, Homo sapiens
ctggagaaaagccatatgagtgtgaggattgtcagaaagtttttagcaagaaggaccacctcattgcacaccagagagttcacactggagaaaggccatatgaatgcagtgattgtgggaagtcatctacccacagctctgcattctgtgttcataagagagttcacactggtcacaccaccttatgagtgcagtgaatgtgggaaatcctttgctgaaactttcagtctcattaaacacaggagagttcacactggagtaaggtcttgtgattgcagcaaatgtgggaaaaaagttacctgaaggtcttttctccttgaatatcagagagttcacactagacaaataaaatacatttgggcaattttgtagccacacctctttgctccttcaagatcagagttaacactggatcagggccttaccagtgtgacatgtgagatatttatgtagaaatctagcttcataacacacaggagacttcccactgcagaaatgccttttgaatgtaatgaatgcaagaaagccttcagcctttttattggagcctcaaacattgacatgagaaaaacaccatagatgtatatggaatgttatttctttttcaatgtaaccctttgagagtgccacctacctagattgaatgtcatttattgagcatctgcaaaagttccaagtgtgtggcagctacagtgcatttttcactatacccaggtaccttgctagattttttttgagacaggttgtcactgtgtcgctcaggatggcgtgcagtggtgtgttcacatttcactgcacccttgatctgggcttaagtgattctgttgcctcggcct

SEQ ID NO: 424417 - DNA, 1393 bp, Homo sapiens
atttttatttatttattttgagacggagtcttgctcttgtcacccaggctccatctcaaaaaaaaaaaaaaaggaaatagttttaagttctcccatccaagtagtaaccaggcccgaccctgcttagcttccgagatcagacgagatcaggcgcgttcagggtggtatggccatagacggaaatagttttaagttctcaacttcaactgaatggttagtggtcagttttgtaatcacaatgacattcttgcaaacaaatacaatgtgtggcatctctctttgatatactggatagttaaaaattgttttaaagttttgcctaatattttgcgatttatctcaatgtaatctgtataagtagtaaaattatagatgactcctttccttttttttttttttttaagacaaggatctagctctgttgcctaggctggagggcaatggcatgatcacagcttactgcaacctctgctcctgcattcaagcgattctcttgcctcagcctcccgagtagctgggcctataggttccctccaccacgcccacctaatttttgtatttttagtagagatgggctttcactacgttagccaggctggtctcaaacttgtgacctcgtgatccacccccctcagcctcctaaagtgctgggattacaggcatctgccacggcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatttttcatccttctcactggaaagatctttgatgatttttaatcaacataggagtttcaatgatatctagaagtttaaaagggctcgttcaaacaaattatgaccatacaccctgaagagtatgtgtctgtctcttgtggtgtaaatttttattttattacacccaattatgttcccacaaaacctttataattgggaaattaaggagccttccttggaaatggaggttgcaatcagctgagatggtaccactgcactctagcctgggcaaaagagcaaggccctgcctcaaaaaaaacaaaacttttttcttcataaactacagtttatataggcaaaactttcagtactaagcaattttagtctctgcaggctcttgtcttgaattaatacaacttttgttaattctcttatgaagttaaatcttcctgcttgtatgcaacttatatgttgaaatttttttgtacaaaagattcatacatctttcctgtttgaaattatttta

SEQ ID NO: 424418 - DNA, 1281 bp, Homo sapiens
aattttgattccaaaaggtcctgttagaaagaaaagagagaacatatttatatttacctccctcccctttatacttattatatttaccctcccaaattgtgattgaactttgagccatagctaatttccataatcctgaatgttcctgtcctatggcaggagatatcatttttggaataggggtgataatgccaccagggctccatataataggaacatcagcttccgtctgaatgtaccgtgtatggttctctttccaatgagtccatcagcttattttataagaaggcccttcagtgcaatttttcttaaccccagccttacttgctacacaatttccccaatgccaagcgtccacaccttcaaaccaaactctattttgtttacattcgagtttgtctggtcagaactgctgagtttcagggctggaatggttatattttaaactttgccctgaaatcatatataaagtagcctgtgatttattttttccagggattactgccaaccatacttgtgtgccaatttgtaagcatccagcagcaggtcctaggcatattggaggatatttatatcctattgatatattcattttcatcccttcctcattaggatgcatcggcactctgttatctatgggctcaggcatcgaggttctgtcattgttgtacacctcaataatagggtccatccaactcacagacctaattaaaggaggaaatgggacataagtccaataagtaaaattttgagttgcttttacagtagggaggcttaccgccacagtaagtaccaccatcatagccaccattaggttactagttgtttttgatttgttctgtgctctcagattgtcctctgccatctgtgccagtttcctgatttgtccccatgttggagggtctgcctggtgagtattcttggtcttttcctttgtctctgagattttcattcatgccatcactcgtatagggagttctggctcttcccagagtcctctcttcctggtgtggctcatgatagaccttcagatgtttggtgggcacccacagaggcacctgattgtcacttggagagacagaagcaaatcctcttccccatgtaattatttttcctttttcccaactctttgtatgtgcatccctccactgtatatcttgtctggcatttttattttccttttgtcctgttaagtgttgttcagctgctgtcatgggctgatccttttgtaaatttaaaaaatttaatgttaataaagcgaggtgtaattgtatatgtagg

SEQ ID NO: 424419 - DNA, 1707 bp, Homo sapiens
gtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagcagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggaaagacagcttatccctgtgaggagtgcgggaaatcttttagtcagaagggcagccttattagccatcagcgtgttcacactggagaaaggccttatgagtgtagagaatgtgggaaaaaagttacctgaaggtcttttctccttgaatatcagagagttcacactagacaaataaaatacatttgggcaattttgtagccacacctctttgctccttcaagatcagagttaacactggatcagggccttaccagtgtgacatgtgagatatttatgtagaaatctagcttcataacacacaggagacttcccactgcagaaatgccttttgaatgtaatgaatgcaagaaagccttcagcctttttattggagcctcaaacattgacatgagaaaaacaccatagatgtatatggaatgttatttctttttcaatgtaaccctttgagagtgccacctacctagattgaatgtcatttattgagcatctgcaaaagttccaagtgtgtggcagctacagtgcatttttcactatacccaggtaccttgctagattttttttgagacaggttgtcactgtgtcgctcaggatggcgtgcagtggtgtgttcacatttcactgcacccttgatctgggcttaagtgattctgttgcctcggcct

SEQ ID NO: 424420 - DNA, 614 bp, Homo sapiens
gtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagcagggcactgtgacctttgaagatgtggctgtgaacttttcccaggaggagtggtgtcttcttagtgaggctcagaggtgcttgtaccgtgatgtgatgctagagaacctggctctcatatcctcgctggattgtcctctgccatctgtgccagtttcctgatttgtccccatgttggagggtctgcctggataagccgtatctttttctgaggcctgcagcattaagatgggttaaggaatggaacgtttgtgcatcggcaaaagctgcagaaaccagtgcatccgccctttgattaagttaaaaggaccagggaggttagtatgtgctctcatatgagtaatatagaaaggggaatgtctttgttgtactgcttgttgtaaagaatgaaataaaagattaagttgttcat

SEQ ID NO: 424421 - DNA, 813 bp, Homo sapiens
ggtggtcggacacaattttgattccaaaaggtcctgttagaaagaaaagagagaacatatttatatttacctccctcccctttatacttattatatttaccctcccaaattgtgattgaactttgagccatagctaatttccataatcctgaatgttcctgtcctatggcaggagatatcatttttggaataggggtgataatgccaccagggctccatataataggaacatcagcttccgtctgaatgtaccgtgtatggttctctttccaatgagtccatcagcttattttataagaaggcccttcagtgcaatttttcttaaaaatccccttaggggaccagtcaatgacgattccataggaattattttgtagcaccccagccttacttgctacacaatttccccaatgccaagcgtccacaccttcaaaccaaactctattttgtttacattcgagtttgtctggtcagaactgctgagtttcagggctggaatggttatattttaaactttgccctgaaatcatatataaagtagcctgtgatttattttttccagggattactgccaaccatacttgtgtgccaatttgtaagcatccagcagcaggtcctaggcatattggaggatatttatatcctattgatatattcattttcatcccttcctcattaggatgcatcggcactctgttatctatgggctcaggcatcgaggttctgtcattgttgtacacctcaataatagggtccatccaactcacagacctaattaaaggaggaaatgggacataagtccaataagtaaaa

SEQ ID NO: 424422 - DNA, 349 bp, Homo sapiens
aagccttcagcctttttattggagcctcaaacattgacatgagaaaaacaccatagatgtatatggaatgttatttctttttcaatgtaaccctttgagagtgccacctacctagattgaatgtcatttattgagcatctgcaaaagttccaagtgtgtggcagctacagtgcatttttcactatacccaggtaccttgctagattttttttgagacaggttgtcactgtgtcgctcaggatggcgtgcagtggtgtgttcacatttcactgcacccttgatctgggcttaagtgattctgttgcctcggcctcctgagtagctgaaaccacaggcatgcactaccatg

SEQ ID NO: 424423 - DNA, 528 bp, Homo sapiens
gcagtggtgcaatcttggctcactgcaacttgggcctcccaggttcaagtgattctcctacctcagcctcccaaggagctgagattacgagtacaccacaccatgcccggccaaatacttggttttcagtaccacaagagctatgagctggttatccacttcatgtggaatcataagtgtccccaagtgacaatacgtatagattgctgggcagtgaaacagttaagatgtcaccgtagcttgctttctattcaacatctttctaagattaccttactatttcttttgttccaagtttgtatttcctcagagttctcacatatggaaaggatacacactttgtagaaacaagaactttatgttatccaagttctgggatagccatgagctccaattacctcagagctccgagtcctctactcagtacccgttgagatttatgtgttctgaggcttttgtcttctagctacttacttcattctccatgggtaacgtcattcatccacattaactaatttcctcactcca

SEQ ID NO: 424424 - DNA, 1538 bp, Homo sapiens
gtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagcagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggaaagacagcttatccctgtgaggagtgcgggaaatcttttagtcagaagggcagccttattagccatcagcgtgttcacactggagaaaggccttatgagtgtagagaatatgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtggaaaatcttttggtcaaaagggcaacctcgttcaacatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctcgttcatgagagag

SEQ ID NO: 424425 - DNA, 527 bp, Homo sapiens
tggagaatgtggaaaatcttttggtcaaaagggcaacctcgttcaacatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctcgttcatgagagagttcacactggagaaaggccatatgcgtgtgaggtatgtgggaaattatttggtaataagaactgcgtgactatacatcagaggattcacactggagaaaggccgtatgaatgcaatgaatgtgggaaatcatttctttccagctctgcgcttcatgttcataaaagagttcattctggacaaaagccttataagtgcagtgaatgtggaaaatcctttgctgaatgttccagtctcattaaacacaggagaattcacactggagaaaggccttatgaatgtaccaaatgtggaaaaacatttc

SEQ ID NO: 424426 - DNA, 2977 bp, Homo sapiens
ggcacgaggaggtaggctgcatccgcccctctgtctgtctgtcaacatcgccctaggaccgagctgctgggtgccccggaagaagggcaggcaggaaggggaggggcagtgaggttggctccccccaccacctcaccctggtgcccccagcccagcccaagacaccagggcatttgctgacatctgaggcccttcccaggaagacatggcctcgttcttggtgtggccactgaggacggcgctgagagggggaaagtcatgggcaggacctggtgtgggatgtggaggagacggcgcccggggaggaggagcgctgtgcccaggtggcctcacttgtcatctcaaagtggcgtcgaaccccctgacaggtggacgggaacccccggctggccctccagagaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggacagctgtatgaagacacagagagaaggcagccatctgtaagccaggaagagagccctcaccaagactggaatcagcagcaccttgatattggacttccagcctccagaactgcaagaaataagcacctgctgtttacatgcccagcctgcagtgcttccttatggcagattggagctaactgagacagctcccagcactcattcattcattcattcattcactcacctcatgtctactaaacagctctgggctggctctgggaagcagtgagtcacacacactgcccccagcaacgtgtgaaatatgtttagagacagtgggctacagcggaaagggtagatgccctgagaaccccagcggtgctggtcagaagcacaggccttgttgggctgaggctggcatggggtgaacctggggagcctcgggggcagaggtgatagatgtggggtgtttcaaggcagtgagacaaagaagggagatgggtggtgccccccaatgccaggcttcaccagcctcccaacacacgagtgttcacccgcctggatgagacacctctgtggacttgggagtgaaggcagtgaatttgggcaatgctggaggccgtgcaggtgggaggtgggacaggggcaagaggccggggcccaggcaggagctgacagcccaccagtggtgctcccctgagaagcaacctcagtgggtggcttggggtctgctgggctgtccccacactgacaccctggctgcagggcccccctgtgtccccagtgaggggtctcgggagctgtgtgtcctactcagggccatccctgcagcccatgctctctgggtgaccagttgccagcagtgtcccccctgccttgggcggaggctgaggaccccagggtgggagggaaggtgcggtgggggctcagccaatgctgcccagcctgagggtccctcacatgtgggccgcacccctgcgtcagccggagtgatctctgcttagggtggtttgaggtgagttctgatatctcaaacaccagcatcagggccagggcagacaaaataagagtgagctggtcaggggtgtcccagttgggagctcgctcacagtctttaaggaggcagggcacagcccagtgggggtggccacgaggccccgggcctgtggctgagatggcaactggcaccggcagtgattggaacagtccagcccatggagccctgtggccttggccggtggctcacggtgccacgggagctggagcaatgggtggcctcccttgcctggtgcctgagtgaaggaggactgggttgcccttgaggaaggaccttgccatactcctacaaacttacattattcttctttccccagtctcccctcagggacctgcagccatttgctggggtggctagtggaaagggggatcatcagactcagggggattactggactctaactctaacctgacacccactcctggggacacaaacacccatcggatctaatagtcagaggaggggcgtatggaggtcagtgggctcacggagttctagctcaggtccaaccctcggtgggtgcagaggtcacttccctagcctcagatgggtgagtaaacagacgtatgtggcagccagcagagcccccacatttgttccctgacctgagggtgggggctactatgctgggaaaggccaggtggaagccattggggtgaactctgcctaggaaaattgtcagtcaaaagcaacctgcagccctggagggactgcaaaggtcagtgccgccatcgaggacttggaagatgcagggtggtgacccccactgcagcctcgttccactcgtctaattggcttgtgtggaagacaggggggtcccggagaaagaaggacagtgaatcctggtaaacttaaccaggactccaattgcaactgctgttccagatatgactactgatcactggggcaaatcaaagcatccccggacacctggtctacagccattgatctggtgaaagctttaatttttaatatagattttattttttagagcagtttcatgtttacagagaaattgagcatatttgagagtcctcatatagcatctctccctacacacagtttcccttattattcatatcttgaattactgtgatacatctttgcaattgatgaaccaatattgacctagtcattgatcaggttacatgagggttcactcttcttgttgtacatgctgtgagttcgggcaaatgtgtaatggcatatctccactattacagtgtcacacagaattattttactgcccta

SEQ ID NO: 424427 - DNA, 2692 bp, Homo sapiens
cgtggatgtgtgtcatgcatatgtgtttacccgccagggacttcctttttcctctctccttcctgtgaattcctgggtcccaggtgcgcccgctcactctacaatgtccttacccaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggacagctgtatgaagacacagagagaaggcagccatctgtaagccaggaagagagccctcaccaagactggaatcagcagcaccttgatattggacttccagcctccagaactgcaagaaataagcacctgctgtttacatgcccagcctgcagtgcttccttatggcagattggagctaactgagacagctcccagcactcattcattcattcattcattcactcacctcatgtctactaaacagctctgggctggctctgggaagcagtgagtcacacacactgcccccagcaacgtgtgaaatatgtttagagacagtgggctacagcggaaagggtagatgccctgagaaccccagcggtgctggtcagaagcacaggccttgttgggctgaggctggcatggggtgaacctggggagcctcgggggcagaggtgatagatgtggggtgtttcaaggcagtgagacaaagaagggagatgggtggtgccccccaatgccaggcttcaccagcctcccaacacacgagtgttcacccgcctggatgagacacctctgtggacttgggagtgaaggcagtgaatttgggcaatgctggaggccgtgcaggtgggaggtgggacaggggcaagaggccggggcccaggcaggagctgacagcccaccagtggtgctcccctgagaagcaacctcagtgggtggcttggggtctgctgggctgtccccacactgacaccctggctgcagggcccccctgtgtccccagtgaggggtctcgggagctgtgtgtcctactcagggccatccctgcagcccatgctctctgggtgaccagttgccagcagtgtcccccctgccttgggcggaggctgaggaccccagggtgggagggaaggtgcggtgggggctcagccaatgctgcccagcctgagggtccctcacatgtgggccgcacccctgcgtcagccggagtgatctctgcttagggtggtttgaggtgagttctgatatctcaaacaccagcatcagggccagggcagacaaaataagagtgagctggtcaggggtgtcccagttgggagctcgctcacagtctttaaggaggcagggcacagcccagtgggggtggccacgaggccccgggcctgtggctgagatggcaactggcaccggcagtgattggaacagtccagcccatggagccctgtggccttggccggtggctcacggtgccacgggagctggagcaatgggtggcctcccttgcctggtgcctgagtgaaggaggactgggttgcccttgaggaaggaccttgccatactcctacaaacttacattattcttctttccccagtctcccctcagggacctgcagccatttgctggggtggctagtggaaagggggatcatcagactcagggggattactggactctaactctaacctgacacccactcctggggacacaaacacccatcggatctaatagtcagaggaggggcgtatggaggtcagtgggctcacggagttctagctcaggtccaaccctcggtgggtgcagaggtcacttccctagcctcagatgggtgagtaaacagacgtatgtggcagccagcagagcccccacatttgttccctgacctgagggtgggggctactatgctgggaaaggccaggtggaagccattggggtgaactctgcctaggaaaattgtcagtcaaaagcaacctgcagccctggagggactgcaaaggtcagtgccgccatcgaggacttggaagatgcagggtggtgacccccactgcagcctcgttccactcgtctaattggcttgtgtggaagacaggggggtcccggagaaagaaggacagtgaatcctggtaaacttaaccaggactccaattgcaactgctgttccagatatgactactgatcactggggcaaatcaaagcatccccggacacctggtctacagccattgatctggtgaaagctttaatttttaatatagattttattttttagagcagtttcatgtttacagagaaattgagcatatttgagagtcctcatatagcatctctccctacacacagtttcccttattattcatatcttgaattactgtgatacatctttgcaattgatgaaccaatattgacctagtcattgatcaggttacatgagggttcactcttcttgttgtacatgctgtgagttcgggcaaatgtgtaatggcatatctccactattacagtgtcacacagaattattttactgcccta

SEQ ID NO: 424428 - DNA, 375 bp, Homo sapiens
tctctccttcctgtgaattcctgggtcccaggtgcgcccgctcactctacaatgtccttacccaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggtgagcagccgggctctgaggctggag

SEQ ID NO: 424429 - DNA, 708 bp, Homo sapiens
cccaggaagacatggcctcgttcttggtgtggccactgaggacggcgctgagagggggaaagtcatgggcaggacctggtgtgggatgtggaggagacggcgcccggggaggaggaggtgagctccccgtcctgggagtgagcaagtgtggactgggccttgggggcgtaatccttggaggaatttggatggggtctccttggaacatcattattgaggtgttcttaggaaacaccctttgaaatgtcctgtgacagcttaagttttgagaaggtcgttggttttaatgccttcgtgggcggcactcatggatattttgtcgcagagccttcttggggccacaggggtgggctggggcctcgctcacactcacgtggggcctccagggggaggctttgtaaacctcgaatttgcaattacaccgagccgtgtaattacgtatgggtgggggcagcgctgcggccccagtacaggcagggtttccgtgggcctctggggcagggtgggcctgaagagggtgaaaatgttccaggtgaatccatcattcagggaccactccgggccctcccaggagtgctaacaggcggctctgctcgcccctcggtgctggaattgctcctcctgcatttggtcaggacctcatcaagggggagggggccccaagacctgcaggcatggcaaccccagcgtggctgtgggaagagggcc

SEQ ID NO: 424430 - DNA, 538 bp, Homo sapiens
gcacgaggactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcacttt

SEQ ID NO: 424431 - DNA, 3191 bp, Homo sapiens
gcacgaggactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtattgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgc

SEQ ID NO: 424432 - DNA, 3844 bp, Homo sapiens
gagttatttctcctatacctatgcaaagtaggaagagcaccttataggaggcactgtatagggacaggggacatgggatcagccataggaatgttaaatgaaattgcacagaggaaagtttaatatatgtctagagattatacatacacttttttaagcgtaaaaagaagacatctagtaatgacagatattctttttatatacaagcaaaagaaagtataaggaggttctacagtgcaacatccacaatctgtgcattcacatattatgggacttttattttttaaactctcatataaattttttaaaattactccttggaagagatcctggtttttttcttcatttatttttttctttaaaaacatttattttaagagaagagaaaaagagcttcatctaattttgcatcttgattaccaatcagtactagtcacagcaccagcaatactgtatgttttagactgacaaggtcagccaggaaatggcatttttttaaacgcagaaatgtgtttgtttcctctactctaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagagatctttgctatggagcagtcctggagcaaagccccgtggcttccacccccagatatataccccataagtagtgctgagctccagcttagctgagccaagctcagtccttatctggtgttcagccagtgcacaggtataagcagaactacagagctgaatgtagcttccctgggatctcttctcctttctaaagcatttttcacacagttctgtacagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtattgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgc

SEQ ID NO: 424433 - DNA, 3355 bp, Homo sapiens
cttggtgctgatcagctggtggtcaccatccctaagtacctcccagggagctgccattttctcctctgggagcagctgcctgaagcaaggagagaatgacctgaagggaagtacctccggccaagagtgcagggctgctgtgcctagcctgagcgggccatctctagcagatatggacttctctccaccacactagctgaaaagttttctcccttggttggcaaaagccagtgtcaggaaaaaagctgtgggtttctgaccaagaatgtgtgcgcttagctgcaaagtgcctgtcagcagctccaggcaccaacaaggtgcccttttattagacaattcctgcccgaacataaccatattgcagatgaaaattttcaatagagaatgacacaattcttgacctttctaaaaacttttcaaagagatagtcacatgtgtatatgttgcaaaagatttttgaaactgaaatgtcctccattaaatctcaagagcactcgagttttaagtctgctgtttctggtgtcacactaagacacacttttgaaagcagccctgggttctgaattagttggcaagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtattgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgc

SEQ ID NO: 424434 - DNA, 3369 bp, Homo sapiens
ctcctggtgtcctgtcaccaggaggagaaaggacgtgttagagtagaggaaacaaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagagatctttgctatggagcagtcctggagcaaagccccgtggcttccacccccagatatataccccataagtagtgctgagctccagcttagctgagccaagctcagtccttatctggtgttcagccagtgcacaggtataagcagaactacagagctgaatgtagcttccctgggatctcttctcctttctaaagcatttttcacacagttctgtacagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtattgatattacctgacacgtaagttttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgc

SEQ ID NO: 424435 - DNA, 1427 bp, Homo sapiens
gagttatttctcctatacctatgcaaagtaggaagagcaccttataggaggcactgtatagggacaggggacatgggatcagccataggaatgttaaatgaaattgcacagaggaaagtttaatatatgtctagagattatacatacacttttttaagcgtaaaaagaagacatctagtaatgacagatattctttttatatacaagcaaaagaaagtataaggaggttctacagtgcaacatccacaatctgtgcattcacatattatgggacttttattttttaaactctcatataaattttttaaaattactccttggaagagatcctggtttttttcttcatttatttttttctttaaaaacatttattttaagagaagagaaaaagagcttcatctaattttgcatcttgattaccaatcagtactagtcacagcaccagcaatactgtatgttttagactgacaaggtcagccaggaaatggcatttttttaaacgcagaaatgtgtttgtttcctctactctaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagagatctttgctatggagcagtcctggagcaaagccccgtggcttccacccccagatatataccccataagtagtgctgagctccagcttagctgagccaagctcagtccttatctggtgttcagccagtgcacaggtataagcagaactacagagctgaatgtagcttccctgggatctcttctcctttctaaagcatttttcacacagttctgtacctcctacccaagttggggctgctttctgcctgctagcccacggctctgtgtactttcttttctggcttcaggtgcagacagaccctcagtaccttcctggacacagacacatattccctggaccaaggcgtggaataactagtagaccaccaagccacaggtggctggtcttgaagaaaagggattatactccttacaggccacccagaaagctatgaattccaatatacaccactgatcgtgcaagttagggttttttttttttaaacgtagcattattttgttatattttggaactaaatgaagtgccaaattaaccagacattcgtttgatgccatctctgtggaaccaagttctctgtgt

SEQ ID NO: 424436 - DNA, 1147 bp, Homo sapiens
ggatatccacagttcgatcaaggtaataatcaaggtcttccgacgtgaacattgcacgccttttgtggatttttagaattccttctttctttctgccatatatctgtctgtttcttttgaattttttcttgtctgtatttcttcttcgtgtttgtagaaagctgatgttgttatacatgtattgtgttttttatgtttcgtcaaggagggatggacgctccttcccccagaaaagacagaaatggaaagctggaagttggcaatgattttcatcagagaagtctacagtgatttgtataggctttatggtagaaagtttgcaatgctctttttgaaagagacctattgaagaggtagaaagttatactctgtttgttgtcctggaaggattggggtcctaggtcccaaagggctcaaggggaagaatagaaaagatgttcagttttatttttacatgcatgaaatctgtgcttcattgcaatcgccaatttactcttttctgtctcaggttgtagatatggtggtagaattgagttgaattaggcaggtgtttagaaagtttcttaggaataggaattaactcattcaatgtttatgcatagaaatatagctgaggtggatgtggttgctgtcagctattcaggtttgctacctgatcacctcctgaagatgtagggtaaggacagaatccaagcctaaaagaaaaaacaaggagagaattgaaagttataggggtgggcagttatatttcttaaaaggctggtagaaatcattttcctaagaatgtgtttagagtacagatattcattttaatctttgatttctttaagttttttgatgtttgattttctaccagtatgacactcagcctctcaaaacaagaaggacattccccaaagttgaaatgaatctgtataagatttcattcaaatgcagaataaattcaaatgattcctaacccctcctcatctactttggagataaaaactgctatgattgttttaagtaaacagagaagtggagatgacaggaaatcatttttcatttgttaaaaatcagaaaacctttgacacacttttagataaatacacctactcctttgatcctttgtgtatgtattaccacagggcttaaatatcttaagatt

SEQ ID NO: 424437 - DNA, 3014 bp, Homo sapiens
tctcagattcagctctgtgtaaagattctctagcgggctgcgctcccaagttcccctgctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaaccaaatatgtgtggaattcatacccaggtgctaaagtcatcagggagggcagggagtcagtacaacacagtgctcacccgtggggaggggacggagctgtgcttagggaagagcagagatgctggaggttttgaacctcagggtcagtggtggcttcgtgggtttcactttgtcgtactttctgtttcacacattttcttgtgaatgtgccaagtattacataaaaaccaaaaggctgaccagacttaacagtgctccacccaatagcagcagaacacacgtttctaagtgcacagggaacattctccaggacagaccacacgttagtgcacaaagcaagtctcagtaaattagagatcggaatcctgcaaaccaccttctccaatcacaatggaataaaaccagaaatccataccagaaggaaaatgaaaattcacacatacatagaaattgaacacactttttaacagccaaagggtcaaaggagaaatcacgagaaaaattaggaaatagagatggatgaaaacaacataccagaacttaaggaatgcggcaaaaactgctctgagggaaatttatagctgcaaatgccaacatttaaaaagatgcgacatcttggctgggtgtggtggctcacgcctgtaatcgcggcactttgggaggccgaggcaggcagatcacctgaggtcagaagttcgagaccaacctggccaaagtggtgaaaccctgtctctactaaaaacacaaaaattagccaggcgtggtggctcacacctgtaatcccagctattcacgaggctgaggcaggaaaatcacttgaacccaggaggcagaggttgcagtgagctgagatcatgccattgcactccagcttgggtgacagagtgagactctgtctcaaaacaacaacaaaaaaattcctagaaagatacaaatgaccaaaattgtcccaggaaaaatagaaaatctgaacagggccaggtgcagtggctcacacctgtgatcccagcacttggggagaactagttaggaggatggcctgaggccaggagttcgagaccagcctgggcaacagagaccctgcctcgacaaaatctttagaaatcaaccaggtgtcatggcacgtgcctgtagccccagctacttgggaggctgaagcaggaggatagctagagcccaggagttcaaagctgcaacgacctatgacagcaccactgcactccagccaggaatgaggcagagacagagaccttacctcaaaaaaagaagaaaaaggaaaaaatctgaaccaacctaaaacacataggtagaaccagtcatcaaaagcttcccaacaaaagaaaagcccaggaccagatggtgaattctaccaaatgctaaagaatggacataaatccccaaattctcccaaacattgtggaggagaaaacacttcctaattccccgtattcatgtgaggggccagcttccctcccattctgccccagcttcctccagtggccttccccagcaggcagtggcccccacttctgacccctgtaactctacccactgtgggtttcctccttgccacccttccagccttccaggctttgggggccattgagacagcccatcctgcctgccctgagtgggagggcaagacatgactggctcaggatggcctgtcacccaagttgcctcaaagaagccagggacatcagtgcagtcggatgcacagtgcagtaggttttggtaagtgcacacgtgtgtgtacctgcccttccaaacctcacaggagagaccaacccacaccccaccccaggtcatcactgttctggcccctgtcaccagagattaattttgccctttctgaaactttatgtcagtgaatattagagtctgtgtcttgttgttaactgaaaaaaaaaac

SEQ ID NO: 424438 - DNA, 3354 bp, Homo sapiens
tctcagattcagctctgtgtaaagattctctagcgggctgcgctcccaagttcccctgctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaaccaaatatgtgtggaattcatacccaggtgctaaagtcatcagggagggcagggagtcagtacaacacagtgctcacccgtggggaggggacggagctgtgcttagggaagagcagagatgctggaggttttgaacctcagggtcagtggtggcttcgtgggtttcactttgtcgtactttctgtttcacacattttcttgtgaatgtgccaagtattacataaaaaccaaaaggctgaccagacttaacagtgctccacccaatagcagcagaacacacgtttctaagtgcacagggaacattctccaggacagaccacacgttagtgcacaaagcaagtctcagtaaattagagatcggaatcctgcaaaccaccttctccaatcacaatggaataaaaccagaaatccataccagaaggaaaatgaaaattcacacatacatagaaattgaacacactttttaacagccaaagggtcaaaggagaaatcacgagaaaaattaggaaatagagatggatgaaaacaacataccagaacttaaggaatgcggcaaaaactgctctgagggaaatttatagctgcaaatgccaacatttaaaaagatgcgacatcttggctgggtgtggtggctcacgcctgtaatcgcggcactttgggaggccgaggcaggcagatcacctgaggtcagaagttcgagaccaacctggccaaagtggtgaaaccctgtctctactaaaaacacaaaaattagccaggcgtggtggctcacacctgtaatcccagctattcacgaggctgaggcaggaaaatcacttgaacccaggaggcagaggttgcagtgagctgagatcatgccattgcactccagcttgggtgacagagtgagactctgtctcaaaacaacaacaaaaaaattcctagaaagatacaaatgaccaaaattgtcccaggaaaaatagaaaatctgaacagggccaggtgcagtggctcacacctgtgatcccagcacttggggagaactagttaggaggatggcctgaggccaggagttcgagaccagcctgggcaacagagaccctgcctcgacaaaatctttagaaatcaaccaggtgtcatggcacgtgcctgtagccccagctacttgggaggctgaagcaggaggatagctagagcccaggagttcaaagctgcaacgacctatgacagcaccactgcactccagccaggaatgaggcagagacagagaccttacctcaaaaaaagaagaaaaaggaaaaaatctgaaccaacctaaaacacataggtagaaccagtcatcaaaagcttcccaacaaaagaaaagcccaggaccagatggtgaattctaccaaatgctaaagaatggacataaatccccaaattctcccaaacattgtggaggagaaaacacttcctaattccccgtattcatgtgaggggccagcttccctcccattctgccccagcttcctccagtggccttccccagcaggcagtggcccccacttctgacccctgtaactctacccactgtgggtttcctccttgccacccttccagccttccaggctttgggggccattgagacagcccatcctgcctgccctgagtgggagggcaagacatgactggctcaggatggcctgtcacccaagttgcctcaaagaagccagggacatcagtgcagtcggatgcacagtgcagtaggttttggtaagtgcacacgtgtgtgtacctgcccttccaaacctcacaggagagaccaacccacaccccaccccaggtcatcactgttctggcccctgtcaccagagattaattttgccctttctgaaactttatgtcagtgaatattagagtctgtgtcttgttgttaactgaaaaaaaaaac

SEQ ID NO: 424439 - DNA, 3124 bp, Homo sapiens
tctcagattcagctctgtgtaaagattctctagcgggctgcgctcccaagttcccctgctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaaccaaatatgtgtggaattcatacccaggtgctaaagtcatcagggagggcagggagtcagtacaacacagtgctcacccgtggggaggggacggagctgtgcttagggaagagcagagatgctggaggttttgaacctcagggtcagtggtggcttcgtgggtttcactttgtcgtactttctgtttcacacattttcttgtgaatgtgccaagtattacataaaaaccaaaaggctgaccagacttaacagtgctccacccaatagcagcagaacacacgtttctaagtgcacagggaacattctccaggacagaccacacgttagtgcacaaagcaagtctcagtaaattagagatcggaatcctgcaaaccaccttctccaatcacaatggaataaaaccagaaatccataccagaaggaaaatgaaaattcacacatacatagaaattgaacacactttttaacagccaaagggtcaaaggagaaatcacgagaaaaattaggaaatagagatggatgaaaacaacataccagaacttaaggaatgcggcaaaaactgctctgagggaaatttatagctgcaaatgccaacatttaaaaagatgcgacatcttggctgggtgtggtggctcacgcctgtaatcgcggcactttgggaggccgaggcaggcagatcacctgaggtcagaagttcgagaccaacctggccaaagtggtgaaaccctgtctctactaaaaacacaaaaattagccaggcgtggtggctcacacctgtaatcccagctattcacgaggctgaggcaggaaaatcacttgaacccaggaggcagaggttgcagtgagctgagatcatgccattgcactccagcttgggtgacagagtgagactctgtctcaaaacaacaacaaaaaaattcctagaaagatacaaatgaccaaaattgtcccaggaaaaatagaaaatctgaacagggccaggtgcagtggctcacacctgtgatcccagcacttggggagaactagttaggaggatggcctgaggccaggagttcgagaccagcctgggcaacagagaccctgcctcgacaaaatctttagaaatcaaccaggtgtcatggcacgtgcctgtagccccagctacttgggaggctgaagcaggaggatagctagagcccaggagttcaaagctgcaacgacctatgacagcaccactgcactccagccaggaatgaggcagagacagagaccttacctcaaaaaaagaagaaaaaggaaaaaatctgaaccaacctaaaacacataggtagaaccagtcatcaaaagcttcccaacaaaagaaaagcccaggaccagatggtgaattctaccaaatgctaaagaatggacataaatccccaaattctcccaaacattgtggaggagaaaacacttcctaattccccgtattcatgtgaggggccagcttccctcccattctgccccagcttcctccagtggccttccccagcaggcagtggcccccacttctgacccctgtaactctacccactgtgggtttcctccttgccacccttccagccttccaggctttgggggccattgagacagcccatcctgcctgccctgagtgggagggcaagacatgactggctcaggatggcctgtcacccaagttgcctcaaagaagccagggacatcagtgcagtcggatgcacagtgcagtaggttttggtaagtgcacacgtgtgtgtacctgcccttccaaacctcacaggagagaccaacccacaccccaccccaggtcatcactgttctggcccctgtcaccagagattaattttgccctttctgaaactttatgtcagtgaatattagagtctgtgtcttgttgttaactgaaaaaaaaaac

SEQ ID NO: 424440 - DNA, 1445 bp, Homo sapiens
tctcagattcagctctgtgtaaagattctctagcgggctgcgctcccaagttcccctgctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaacca

SEQ ID NO: 424441 - DNA, 1105 bp, Homo sapiens
tctcagattcagctctgtgtaaagattctctagcgggctgcgctcccaagttcccctgctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaacca

SEQ ID NO: 424442 - DNA, 1804 bp, Homo sapiens
accactggatctataaaacaactaaaggtaatttttagtcttagccaagaaaagctaaccaaacaagctgcaaaaaacacagatccccaaactttctttattaaagagatttggaatatttttgtcaatgtatgacttttcagccacaattacatgtcatcattttaggatggcaccaatacttgggacacgatgatttaggcaccccaccaggtaagcaaactcagcattaaggatgtagttataaaattagcgcataatggtaggtaatgcagtttgaaaccatttcactcaggtaaaatgcaacctgaccacattatttaaaaatcagcagaattttctaataactactctgagtgcaacaacaagtgaaaaaggagctcaaagagtgctcattaagagtaacaataatttctagggaccttgactttgcatttgaggaaaatcttgtgtaactttattccattatgctcctaatatgctttctaatcccaaattaaaactctaatacaaattcattttgtagaagtcttaaaatcagtcctctttctttttgaaaacattattttagtatttattttaattaattggtttcttaaaaaatcatacactagtcattgacatatgtaatacttcctttaccagagaagactcaaccaatgctgccttaagatttaatgttattccctttttagtcactgtgcatttataagtttgtttactagttgacctttcctgaatagagattagtttcggcatttctccatctgtatataaataacaggtaatatttaatcatcagtgtatgacttgatatcacataacgttctggtgtggtttcctgtagtgatcttagggttttgatttaaaagaaatacacaaaacattaggtacaatttcctttagtttgctaaacacccaaaggatattttgttttgttggttctgcacttaaactgaaatacaacctatgtgaactattgggcaaagcctgcagcctaattaattaaaacctccatttttatttgaatagattcaagtagaaattgccgttaggaatcactgggatcttttcggattttgaccttttcaaaggtagcaataactactccagaggttgtaatctttctgttggtagtggcttttcatcagctaaataatcatctctgcctcaaatgtgttgcctgtcacctagttgatgttccataaaatccctgggttctgaagtgaattattataattaataatcaggagggcgaatcttcagtggcatctgatggaatgaaagaactgtgtctgagcagcctaaaagctgtttgtgacatgccaccttgggaaacaagagtgaggaagaaaacacagtcatcaagtgccagcgtgtgccacccattgtactaggtactttattatgcatttatgtatatgtgtgtgtgtctgtgtatacacacaaacacatatacataagtgtttacacacacacacgcacaatatgtggttaagcctggtaagcctgctaaaatggcaaagcggcctggcgcgtggctcacgcctataatcccagcactttgggaggccaaggtgggcagatcacttgaggtcaggagttcaagatcaggaccaacatggtgaaaccccatctctactaaaaatacaaaaattagccgggcgtggtggcaggtgcctgtaatcccagctacttgagagtctgaagcaggagaattgcttgaacctgggaggcggaggttgcagtgagccgagaccatgccactgcactccagcctgggcaacaaagctagactccatct

SEQ ID NO: 424443 - DNA, 1546 bp, Homo sapiens
  misc_feature (1538)..(1538): n is a, c, g, or t
  misc_feature (1542)..(1546): n is a, c, g, or t
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgctcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatanaaannnnn

SEQ ID NO: 424444 - DNA, 3169 bp, Homo sapiens
agcggtgctcaacggcgcgtgcgcagagggaggcaggcgggtgggctgccggcggtggactcgtcggagccgcgggcggtcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaactttagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttca

SEQ ID NO: 424445 - DNA, 3722 bp, Homo sapiens
agcggtgctcaacggcgcgtgcgcagagggaggcaggcgggtgggctgccggcggtggactcgtcggagccgcgggcggtcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaactttagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactagttt

SEQ ID NO: 424446 - DNA, 3176 bp, Homo sapiens
gggctgaggagatccgaggagatgcagctgggggaggggagcgaggggctctgaagagatttgcggttgcagcatctcgggaggtatgaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaactttagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttca

SEQ ID NO: 424447 - DNA, 3230 bp, Homo sapiens
agcggtgctcaacggcgcgtgcgcagagggaggcaggcgggtgggctgccggcggtggactcgtcggagccgcgggcggtcagatgagtgatggggaaagagcttttggaagtttgagttaattccttatggtcatgcagctaagaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaactttagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttca

SEQ ID NO: 424448 - DNA, 2746 bp, Homo sapiens
agcggtgctcaacggcgcgtgcgcagagggaggcaggcgggtgggctgccggcggtggactcgtcggagccgcgggcggtcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaactttagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccccccccgcttgtacctgcgagctttatctccttatgcacaattcacaggaatttcggggaagtatgtcctattgctaaaggattctctgacctgccatcccccaggatgatcatctattactattgctgaatgatggtctgtatcttctttgttttgaaggtggctagatgtttgctgtggacttgtatgggagaattatattcttccactgtacaccccctatgagccttaagccatttcaattgattaggcgagagagactaatctgactctgctctgaggtattatatcccttactcgtgatcatagtctgcctccgcccccgtctccg

SEQ ID NO: 424449 - DNA, 1913 bp, Homo sapiens
acatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagcaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaag

SEQ ID NO: 424450 - DNA, 382 bp, Homo sapiens
caagagcatgcacattggatactccgttctttaatatgtccaatgcacaaaatatgtccaatttttaatagtctttcttcttctcattttcagattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaac

SEQ ID NO: 424451 - DNA, 396 bp, Homo sapiens
gacatgatttgggtctggtcaggttagaaaacatcatataacaacaaagaatttatatttgttcattttttcccttgacagattgaaaatagtccccaggattttgctcttcacattatttttgcaacaggaggtaagaaagcttgatcacactttttacctgactctagagtgctacagtttgctgcccagggggaaggcagaagaacagtttgcctcattctgtggagaaaggggaggaatgggtaggagaaaaggaaggagtggtctttagaacattatctatagtccacaattttaaagaaagataacttaagaataaggtatccctgaagggttgattatatgaaagagtttgcttgttggccagacattaaattatctaaatggagatca

SEQ ID NO: 424452 - DNA, 411 bp, Homo sapiens
gatatgaatatattttgcaggtatttccccagtttattatttgccttttaaattttatggtcttctttacataaaaaggttttccctcttttttatttataatcagattatcttttactgttgtgatttctactttaagctatttagaaagcctttcataatcttgaaaccagatcacagtttacatatatatacttctaagttttaattttattgtttttttcccttaaaaaatatatgtatgtgtttatgtgtgtgaatatatgtatatgcatatatatctgtgtgtatgtgtgtgtatacatgtatatgcatgtatttagcccctaatccacctttaatttgtttgtgtctattgtgtgtgatagaaatctaattgaattttttattcaaataaataatcaactgtcg

SEQ ID NO: 424453 - DNA, 582 bp, Homo sapiens
gctggcagagatcttggggcgagaatttattctctcagagaaatggtagtgatggaccatggaaacttgtctatggtaatctgtgttagaatatattcttgaaagttctaagaatacattatatccacaagtagattatgccatcctagagactgcagctgacccttgaacaatgtgagtttgacccatgtggatccacatacacatggatttgacttttttttttttaagagatgaggtcactctctgttgcccaggctggagtgcagtgtacagtcatagcacattacagcctcaaacatctgggctcaaacagtcctcccatctctgcctcctgagtatctgggactgcatccacacactaccttgtctggctacacttggagtttcttctgcatctgccactctactgccaccctaagtcgtaatccctatgttgttcaagggtcgattgtattttcctttcacagtctatttgtgtagctagtaggcaatcttccaaaaacttcaatttaggtcgttccggagtgcttttcgagttttcagttttcttctatgccagtgaaggagagggatggagga

SEQ ID NO: 424454 - DNA, 1302 bp, Homo sapiens
gtagagatggggtttcacagtgttagccaggatggtctccatctcctgacctcgtgatccgcccaccttggcctcccaaagtgctgggattacaggcgtgagccaccgtgcccagcccaaatctccagtttctaaactggtaagctcaagttgctatgcctcaaggaatttgagagaatatttaatataagattcaggacccaatagtaagaattctactcaggacatctgatcttcattgaaaaggattctaatccaacttcagtcctcatagcaaggaagtactatttcagaaagtccctagattctcagatgcattggcaagcaccatacactgaagaattcacagaagattttagtcacttgctcactcatccacttgaagtaagaaaaatcaatcactgcatgtttattgttctataataaagcaaatgttagaaataaaagttagaaatgtcaaacacactaaattgttacataataaactaatcaagacacaacttttattcaggacatggatatttctgaaatgaaaataaaagaagagaattgacttaaaatgtttataaatacgaatattatgacagaaccaaagctatttatgagcattatttttaaaagcttgtttaagtatcatgcacttgtctgtgtgacattttgtaaagcggagaaaaattaaggagaaaggaattgtagaacactaacaggaagaggacagatactgaggaatggctcatggtataagtgagattatcagagactctctacaatggaatttgaaacgcagggagcacatttggtgtatggttgtagaggacttacactaagggcattcttctgctacctctgccagcagatgagtggctcctgagaatgcatacccaatttaattccccagctgttcacatgcatataagcagctgctgctgttactgcctaatacttatggcagtcttgtcagcacctctaatctctgccatagcagacaagccactcacctaaggcctctgctgtacttccaaagaaagaatttctcaagtagagactgagtggaactagactgccagctgtgagcctcagagctcctggctgcctgttgctgagtctatcagctgctgagcctttctcaccaaaaaaaaaaaaatgagcttaataaaataaccctgcacagaaattttctgaaattaagataacattcaatggaaaacagaatttaatctacagaaatacacttcacagatgttttaggaacagaacctagagaaaatgaaagtcaaaatttaataaaagaatttgtcagga

SEQ ID NO: 424455 - DNA, 2975 bp, Homo sapiens
  misc_feature (2942)..(2942): n is a, c, g, or t
  misc_feature (2949)..(2949): n is a, c, g, or t
  misc_feature (2972)..(2972): n is a, c, g, or t
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424456 - DNA, 2959 bp, Homo sapiens
  misc_feature (2926)..(2926): n is a, c, g, or t
  misc_feature (2933)..(2933): n is a, c, g, or t
  misc_feature (2956)..(2956): n is a, c, g, or t
cgagcggggcggagcgggagaagggcggaaagggtggccgagcgcgggcggaggacggagaagggggcggcgagggccggaatctcgagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424457 - DNA, 2857 bp, Homo sapiens
  misc_feature (2824)..(2824): n is a, c, g, or t
  misc_feature (2831)..(2831): n is a, c, g, or t
  misc_feature (2854)..(2854): n is a, c, g, or t
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424458 - DNA, 2841 bp, Homo sapiens
  misc_feature (2808)..(2808): n is a, c, g, or t
  misc_feature (2815)..(2815): n is a, c, g, or t
  misc_feature (2838)..(2838): n is a, c, g, or t
cgagcggggcggagcgggagaagggcggaaagggtggccgagcgcgggcggaggacggagaagggggcggcgagggccggaatctcgagcttgttttcacttgctttttaaagacagaaagctcatggtgcaaattgttatttccagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424459 - DNA, 2799 bp, Homo sapiens
  misc_feature (2766)..(2766): n is a, c, g, or t
  misc_feature (2773)..(2773): n is a, c, g, or t
  misc_feature (2796)..(2796): n is a, c, g, or t
agtcggaagtgcgcaggcagtgctcgcggcggcggcgacggcggcgggaggttcggttgtcgcccgttggccgcgcggcgccgcgctcggcggccgccattgcagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424460 - DNA, 2998 bp, Homo sapiens
  misc_feature (2965)..(2965): n is a, c, g, or t
  misc_feature (2972)..(2972): n is a, c, g, or t
  misc_feature (2995)..(2995): n is a, c, g, or t
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaacacacaaacaacaacaaaaaaaaacaaaaaaacaanaaaaaanaaacacaaaaaaaaacaaaaganaaa

SEQ ID NO: 424461 - DNA, 2494 bp, Homo sapiens
  misc_feature (2461)..(2461): n is a, c, g, or t
  misc_feature (2468)..(2468): n is a, c, g, or t
  misc_feature (2491)..(2491): n is a, c, g, or t
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424462 - DNA, 1394 bp, Homo sapiens
  misc_feature (1361)..(1361): n is a, c, g, or t
  misc_feature (1368)..(1368): n is a, c, g, or t
  misc_feature (1391)..(1391): n is a, c, g, or t
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424463 - DNA, 864 bp, Homo sapiens
  misc_feature (831)..(831): n is a, c, g, or t
  misc_feature (838)..(838): n is a, c, g, or t
  misc_feature (861)..(861): n is a, c, g, or t
gaagctatggggtctagggtactggaggtcctgccgggttgttttaaagtctgagcacggaaaggactctggtggtcgcctgatggctgtgcctggtgctggctcggggacgcattgccttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424464 - DNA, 909 bp, Homo sapiens
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggaagaaatcactgtgctttgttcggcctggtgtgcaaggatggttggtggttttcctgcattgtatcttttcttactgtttctttaataaatgggatgagagggc

SEQ ID NO: 424465 - DNA, 648 bp, Homo sapiens
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccattcaacgcctccgggccattcaacgcctccgggccattcaacgcctccgggccattcaacgcctccgggccattcaacgcctccgcctccgaggccattcaacgcctccg

SEQ ID NO: 424466 - DNA, 564 bp, Homo sapiens
gaagctatggggtctagggtactggaggtcctgccgggttgttttaaagtctgagcacggaaaggactctggtggtcgcctgatggctgtgcctggtgctggctcggggacgcattgccttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgaggtgagggggcttttctttccctgcctaatgcctcaggaaagcaagctacaccaaggtggtgctcccaggacccagagtgaggactgcctcaggtttgttattcaaggcctagctaatctgcgatgctctctgcttgttctccccctacctctgcagtagcagggaaatttaattttggggaatctggaaagctcacatttctgaaagtggaaattctcctatgtggggctagaaagtaaaaagggcacatgggtgggtggtccagtgtgg

SEQ ID NO: 424467 - DNA, 130 bp, Homo sapiens
ggaggacggagaagggggcggcgagggccggaatctcgaggtacgtgcgggaaggggctcttcccggggttgggagggagcccagcccgctatgcttgcgggagcggagtagaactggaacctaggaagt

SEQ ID NO: 424468 - DNA, 2921 bp, Homo sapiens
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggc

SEQ ID NO: 424469 - DNA, 2988 bp, Homo sapiens
  misc_feature (2955)..(2955): n is a, c, g, or t
  misc_feature (2962)..(2962): n is a, c, g, or t
  misc_feature (2985)..(2985): n is a, c, g, or t
gaagctatggggtctagggtactggaggtcctgccgggttgttttaaagtctgagcacggaaaggactctggtggtcgcctgatggctgtgcctggtgctggctcggggacgcattgccttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424470 - DNA, 2917 bp, Homo sapiens
  misc_feature (2884)..(2884): n is a, c, g, or t
  misc_feature (2891)..(2891): n is a, c, g, or t
  misc_feature (2914)..(2914): n is a, c, g, or t
agtcggaagtgcgcaggcagtgctcgcggcggcggcgacggcggcgggaggttcggttgtcgcccgttggccgcgcggcgccgcgctcggcggccgccattgcagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424471 - DNA, 2711 bp, Homo sapiens
  misc_feature (2678)..(2678): n is a, c, g, or t
  misc_feature (2685)..(2685): n is a, c, g, or t
  misc_feature (2708)..(2708): n is a, c, g, or t
ttcttgttctgccaaagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424472 - DNA, 2849 bp, Homo sapiens
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatggatctgcgcacagggggcggggggggccggccaaaccgggtgcggccggggagagggggggccccggatc

SEQ ID NO: 424473 - DNA, 2587 bp, Homo sapiens
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgaggcttcagtgcctgaccaggcttcagtgcctgaccaggcttcagtgcctgaccgggcttcagtgcctgacc

SEQ ID NO: 424474 - DNA, 949 bp, Homo sapiens
  misc_feature (916)..(916): n is a, c, g, or t
  misc_feature (923)..(923): n is a, c, g, or t
  misc_feature (946)..(946): n is a, c, g, or t
agtcggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagatcaggctcattggcttcaaatccagcacctttcccggctggtgctcgtgacccaagtatggcttcttttccaagagggatgaatcccactggcacagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424475 - DNA, 738 bp, Homo sapiens
  misc_feature (705)..(705): n is a, c, g, or t
  misc_feature (712)..(712): n is a, c, g, or t
  misc_feature (735)..(735): n is a, c, g, or t
gaagctatggggtctagggtactggaggtcctgccgggttgttttaaagtctgagcacggaaaggactctggtggtcgcctgatggctgtgcctggtgctggctcggggacgcattgccttgttttcacttgctttttaaagacagaaagctcatggtgcaaattgttatttccagtgcgagggctggaggcctggcagaatgggtgtttcgtcccacagctttctgcccattgtttcttactagtttcttgaattgttcttgtggacttttcctcagtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaacaaaaaaacaanaaaaaanaaacacaaaaaaaaacaaaaganaaa

SEQ ID NO: 424476 - DNA, 617 bp, Homo sapiens
cgagcggggcggagcgggagaagggcggaaagggtggccgagcgcgggcggaggacggagaagggggcggcgagggccggaatctcgagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggc

SEQ ID NO: 424477 - DNA, 5426 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 424478 - DNA, 280 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagtaagtaccttgtaaatgatgaatgaatgtatgaaccaatcagctgacaaacaacaatttgtcctggagggggacccagttcctgccacagttgatcttagtacaatgggaggaaa

SEQ ID NO: 424479 - DNA, 6048 bp, Homo sapiens
cggggctcccggggcgcgcggacccccgccaggggccgtgtaggcgcggagccccagccggcctgccttgggtccgaagaaagttgtggcttggagctagtcctccttctacgacccctgggggcgtccttccttctttttgagcccgcgatgagaaggcgctcccaccccatccccggggtctctgagacttcctggcgagctggggcggcgcggcaggtgcagggctggggagggcctgacagccctggagagtgcccgaccccaatccgccgccgtcttctaggcggattccccagaggcaggtcccagtccctggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctctcgccccgagcgaggcaggtgccgtgggcggccccggctacttctgcatttcgagcgcttactttgcattcagctctaagtcggagagctctggggacagccgagagtgccagtggcctcatagggagactgagggttctgtttcacctcgggcgccgtgtgggtctgggctgtccacagcacctctgcgcctcagtgataggagaagccaagcgcgaggcctctcaacgctgcgtgcactctatttcccaggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 424480 - DNA, 5455 bp, Homo sapiens
ccggcccgccgatcgctggccgaggcgcagctgaagcagccccccagccgcggcgcccccactttccaactccacggttcctgcggcgcgggcgcgatgcagctggcccggggtgaaggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 424481 - DNA, 5200 bp, Homo sapiens
gtggctagtgaggcccagcctgtatatttctaacagggcgccccatgccccagcaccctccccactgggaccactcctcatagaatagccccactccaaagcatttatgacttgaaccttctgaccaaagctctctgaatcttgggggaacctagaagaggaaaaggaatgtcaggctctgtcagagtcagccaagcgagatcagccaggggtctgctccctgcagaccatacggggagccagggtttgcaatgagtctaaactggaatcttaccctgcaaaacgaatggccactattagagttttccaaaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 424482 - DNA, 5826 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaacaaaacaaaccagaaacgaagagggcgcggcggcgccggcaagtgacacgagttctcagcggcgcggcataatacacagtcagtcagcagatcgatcgcactcagatgatcggcgcgaacagaacaatgcgtcagtggcgaaaaaacaccgagacaggagaaggagatgaaacaacaagggaaggaggaaagacaaaaacgccgaactaggaatggaaccaacaccaagttgtggaggtcagacatacgcaacaaccacgacagagaaagacgagcgcacacaaccaatgttctcgaa

SEQ ID NO: 424483 - DNA, 5522 bp, Homo sapiens
  misc_feature (5436)..(5436): n is a, c, g, or t
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagcttttttttntttttgtaagaaaaaacttgcgggccgcatttggagcctactgtgccaattcgccctattgtgagccgaatacaaataactgaaag

SEQ ID NO: 424484 - DNA, 4526 bp, Homo sapiens
tcctggtggtgctgctgaccatgccctgttctgtgcctacagtgaaggtgactggtgggaggctcggtctctcagctccggaaaaactggctgcattcccacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 424485 - DNA, 5641 bp, Homo sapiens
  misc_feature (5340)..(5340): n is a, c, g, or t
  misc_feature (5344)..(5344): n is a, c, g, or t
  misc_feature (5348)..(5348): n is a, c, g, or t
  misc_feature (5375)..(5375): n is a, c, g, or t
  misc_feature (5383)..(5383): n is a, c, g, or t
  misc_feature (5391)..(5391): n is a, c, g, or t
  misc_feature (5417)..(5417): n is a, c, g, or t
  misc_feature (5462)..(5462): n is a, c, g, or t
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttggagacagagtctggttctgtttcccaggctggagtgcaggggtgggatctcagctcactgcaacatccgcctctggggttcaagtgattctcctgtctcagcctcccaagtagctggaattacagggacccgccaccacgcccggctaattttttggggtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcngcantgancccaccgggaggcgccaaaccagagcncggagccntggctccnagcatgagcagcacagggccgtgggncagtccggggcctccagagcacaggccacacgcggctacaagctnggggagtgccaggggcagtttcctttcagcgttaaacaccgtgccacaccaggacccgagatcccacactgtggtgcacagaaggaaccaaatgaggccgggcccggtggctcacgcctgtcatcccagcattctgggagccgagccgtgatcatgaggtcaggagattgagaccatcc

SEQ ID NO: 424486 - DNA, 4128 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccctcagcaagggagccatacatttttgtaacattttgatatgttttaatgcatctgacttagatcttactgaaataaagcacttttcaaag

SEQ ID NO: 424487 - DNA, 3963 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaattggggtaagaagacgaagagtaggcaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggagactaatatccagaaatcctcttacctcgagtctacgcgcaacgtgaagcccactccagcctag

SEQ ID NO: 424488 - DNA, 3169 bp, Homo sapiens
acatgattttcttctcgggctgcaaacaaagggaagcctgcaacaagttaagctgaagaccgaagcaagagctggttcagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaa

SEQ ID NO: 424489 - DNA, 341 bp, Homo sapiens
tggatctgagctggttggtcatgctgctgctctgcatgtctcactactcaatccctccccgagggcctcatcagactcctctgtctctgtccttaggtggcctctcagagtctgagactggtgagtagggaggagcctgtcttgtgctggggagttgtatgtattctctggttctgtgggtcaggagtaggggtgctgggggctcacatttatttctcagttagtggccttgtcagctgttcagggtgccccttggccctttatctcaccaaaccgctcagccacagggtgggtcctgagcaggagtggtggctgtgtgaatgggaaggtgtggggagaat

SEQ ID NO: 424490 - DNA, 3256 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaa

SEQ ID NO: 424491 - DNA, 3679 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaaaaaaaaaaaaaaaaaaaaaaaaaaaaaaaaaaaaaaaaaaaaaaaaaaaaccaaataaaaaaaaaaaaacaataaaaataaaatattataatatatatattaaacaattatatcacttttaaaaactttaatcatcttccacttataaactctcttaccataactaaactttccctcatatctctttatccccatatttctctattaacactttaattacttcattcaaattctatattcttttcttacacttttcgcatatcactttatattattatatcttacttcttataatatcttcatactatctttatatattacctttccaatccataaacttctctctatcttttctaccattcttccttctatttccacataatcacactcttttatcttttcatttcttacctccacttcat

SEQ ID NO: 424492 - DNA, 3515 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaaggtactgggccctgcttaggacatagcttaccggacaaagctattctccatattttggggtttctcagtttcctcagagaaagggaggctggttcgttttagttcctccattaatctcagttgacaaactccttttctcattccatcctggctttttcctgcctcttccaacctggtaggggcccgtgggatggacagagggctgcaaaggaaattcagctggggcagtgggtttttctgcgccttttctcctaccgcagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaa

SEQ ID NO: 424493 - DNA, 3292 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagtcacctcactgccctgtccctgtcctttcccctagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggttagtgcgtactctgaggctggggggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaa

SEQ ID NO: 424494 - DNA, 2824 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccctggggaaggcaatctgattctgaagctaaagagctttcatcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaa

SEQ ID NO: 424495 - DNA, 951 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggccatctcagagtctgagactgggcccatggaggaacgtggagcggacagagtcctaccagaacccgaggtgcttggaagactgtggagtggacacgcaggatgcggctacgggaacagctgcaaggcccagattgctccttaccagtgtgcccaagacttgcaataaccatgggtcattcatgagtggaccaaggctgggcaaagaagaaaccaggagactccggttgctgccggccactagctgccagacccagaaacgaagaagtcagaagccgtatgaccagacccatgggctagacggcggcaactgccag

SEQ ID NO: 424496 - DNA, 182 bp, Homo sapiens
tggaaccaggcttggttctggaggctgctgcccagcacttgaaccttggaacccagccaaggctgctttctgcattctgcccctcctgaagggagctcccatccttaagagagctttcttctgcaggtggcagccacagcagcctcagggacctcagcaactatggcctcctgcccagactc

SEQ ID NO: 424497 - DNA, 320 bp, Homo sapiens
cccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaatgcctctcctgttttgggcactca

SEQ ID NO: 424498 - DNA, 2689 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagcta

SEQ ID NO: 424499 - DNA, 3201 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaa

SEQ ID NO: 424500 - DNA, 3360 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagtgctaggccactcggggattgtgccaatgaggtggttggagtctgagcccagcaatcaggcaggatctggcagtacccggactgggtctaccaaaggaggagggggaggtcaaacgcgcgaaattgaaaaaaggggggcaaatcagcggcatccaattaggcaagtaaagcggcagggttctgtcgttctattttgtgtgttattagaccatcagcacccaccatcctcaacacatataccgactacatacactaaaaaccaacacacaacatcaacaacacaacaaga

SEQ ID NO: 424501 - DNA, 2896 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtggggatagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgtgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagcta

SEQ ID NO: 424502 - DNA, 1130 bp, Homo sapiens
acatgattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggttagtgcgtactctgaggctggggctttgggcttccatgctgcctgccttcctgccatgttctcaccttacctcacatcacccctccccgagggcctcatcagactcctctgtctctgtccttaggtggcctctcagagtctgagactggtgagtagggaggagcctgtcttgtgctggggagttgtatgtattctctggttctgtgggtcaggagtaggggtgctgggggctcacatttatttctcagttagtggccttgtcagctgttcagggtgccccttggccctttatctcaccaaaccgctcagccacagggtgggtcctgagcaggagtggtggctgtgtgaatgggaaggtgtggggagaat

SEQ ID NO: 424503 - DNA, 1957 bp, Homo sapiens
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcccggctttcctggatatcaggacttccaataaataaagactctgtatactggg

SEQ ID NO: 424504 - DNA, 2728 bp, Homo sapiens
  misc_feature (1821)..(1821): n is a, c, g, or t
  misc_feature (1937)..(1937): n is a, c, g, or t
  misc_feature (2354)..(2354): n is a, c, g, or t
  misc_feature (2564)..(2564): n is a, c, g, or t
  misc_feature (2631)..(2631): n is a, c, g, or t
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggtagggcgccgccgtgacagattagtccccatacgtgctgccgctccccttcttttacccagtgatctagacctagtctaggacctcgggaactaggaccagcctccctccttcttggagatctgaccctcaggattcagcgccttcgctcacgagctccaaccctccgcatgcccaagccccgccctctaagcgtttaggcctcgccccctctcgcgctgcttaggacttcggtccagtcactcttcacccaatctctgcccccagtaccccaggtccggccttcacactgaaatcctaagactacagacttatttagggacctctatgactcctacacccatcntcagagctccaggttcctcccccttgatcaccaaactttaccttttgaaccttccagatctgcctgggaccccagtcctcacctatagggtccacagacttgttcctagaccactntgaccttgcccaggattcccagagcaccaacctcatccagggcttccagacttcacgcccctgggaccttgagtcccgcaccagggccttaggtttcatcttgaagactctttggctaagacactcttccccaggacctgagaccccacctcttggagctctaaacctcacttttagaacccccaaacccattaagggctctcaagctctccctggaattctagatctttcttctaaggccccaagtcttctgtgcatgatccccaggcctactgggggatgcctggatttcaaggcctgtcttctaggaccctgaaggcctaccttacattaatcagactttgttttagaacctccactctctccccagaagctcccctcctgctttacaagccccagggctgggcctcacctctncacttctttggcaccatctcaggatccttcagattcccacatctgccctgaactcctagtcctacttcagacccagaccagaactccctttctttgcggagcaccatagcttatgcctgtaatcctagcactttgggaggtctaagcagggggatcgcttgagcccaggggttcaataccagcctcggcaacatagcaagaccctgtctntacaaaacataaaaaattagctgggcatggtggctcatgcctgtggtcccagctacttaggaggttngggcaggaagatcacttgaatccaggagttggtggctacagtgagctatgatcgtgccactgcactccagcctgggccacagtgagaccctgtctct

SEQ ID NO: 424505 - DNA, 2120 bp, Homo sapiens
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcccggctttcctggatatcaggacttccaataaataaagactctgtatactggg

SEQ ID NO: 424506 - DNA, 2885 bp, Homo sapiens
  misc_feature (1978)..(1978): n is a, c, g, or t
  misc_feature (2094)..(2094): n is a, c, g, or t
  misc_feature (2511)..(2511): n is a, c, g, or t
  misc_feature (2721)..(2721): n is a, c, g, or t
  misc_feature (2788)..(2788): n is a, c, g, or t
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgtgagtagtgagagcgcctaccccatacgtgctgccgctccccttcttttacccagtgatctagacctagtctaggacctcgggaactaggaccagcctccctccttcttggagatctgaccctcaggattcagcgccttcgctcacgagctccaaccctccgcatgcccaagccccgccctctaagcgtttaggcctcgccccctctcgcgctgcttaggacttcggtccagtcactcttcacccaatctctgcccccagtaccccaggtccggccttcacactgaaatcctaagactacagacttatttagggacctctatgactcctacacccatcntcagagctccaggttcctcccccttgatcaccaaactttaccttttgaaccttccagatctgcctgggaccccagtcctcacctatagggtccacagacttgttcctagaccactntgaccttgcccaggattcccagagcaccaacctcatccagggcttccagacttcacgcccctgggaccttgagtcccgcaccagggccttaggtttcatcttgaagactctttggctaagacactcttccccaggacctgagaccccacctcttggagctctaaacctcacttttagaacccccaaacccattaagggctctcaagctctccctggaattctagatctttcttctaaggccccaagtcttctgtgcatgatccccaggcctactgggggatgcctggatttcaaggcctgtcttctaggaccctgaaggcctaccttacattaatcagactttgttttagaacctccactctctccccagaagctcccctcctgctttacaagccccagggctgggcctcacctctncacttctttggcaccatctcaggatccttcagattcccacatctgccctgaactcctagtcctacttcagacccagaccagaactccctttctttgcggagcaccatagcttatgcctgtaatcctagcactttgggaggtctaagcagggggatcgcttgagcccaggggttcaataccagcctcggcaacatagcaagaccctgtctntacaaaacataaaaaattagctgggcatggtggctcatgcctgtggtcccagctacttaggaggttngggcaggaagatcacttgaatccaggagttggtggctacagtgagctatgatcgtgccactgcactccagcctgggccacagtgagaccctgtctct

SEQ ID NO: 424507 - DNA, 2313 bp, Homo sapiens
  misc_feature (2187)..(2187): n is a, c, g, or t
  misc_feature (2215)..(2215): n is a, c, g, or t
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcccctctgctgccagtctgctggtgtttgctggaggtcccctcctgaccctgttttcctgggtatcaccagtggaggctgcaaagcagcaaagattgctgcttgttctttcctctggaagcttcgacccagcagggaacctgccagatgccagccagagctcttctgtatgaggtgtctgtcagccccaactgggaggtgtctcccagtcagtatacacaggggtcagggatccacttgangaggcagtctggccttagcaggctcgcntgctgtgtgggagatccgctgctgtcttcagagccatcaggcagggacgtttaagtctgctacaagcctgactggggctgctgcctttttttacagag

SEQ ID NO: 424508 - DNA, 651 bp, Homo sapiens
cggcattgacagcggcgaaagagtagcgcgcatgacagatatctaagggaacggtgtagtcatggctacggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcccggctttcctggatatcaggacttccaataaataaagactctgtatactggg

SEQ ID NO: 424509 - DNA, 510 bp, Homo sapiens
atgatcctcagcccatcctgtcccacaggcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcccggctttcctggatatcaggacttccaataaataaagactctgtatactggg

SEQ ID NO: 424510 - DNA, 2205 bp, Homo sapiens
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccagtgagtgcgggcaagtatgagacagtgtggggggtgggcagtggggtgggaatctcccaggggctgaactgccctacccccacagcccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcccggctttcctggatatcaggacttccaataaataaagactctgtatactggg

SEQ ID NO: 424511 - DNA, 2492 bp, Homo sapiens
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccccgcccctcccctgcagagtggccagatggagtcctgagccctggacatgggcccggctttcctggatatcaggacttccaataaataaagactctgtatactgggaaaaaaaaaaaaacaaaaaaaaaaaaaaaaaaaaaaaaaaacgggggttttttggggggggggaaaaaaggtaagggcggtgtaaagcgtgtgcccagacccccagtttttttgcacagcggggagactggggggccccccaaaggggaggcgaataaattcggaacagcgggtaccttgtaagagttctcctagcaccccccggatatacacggccatcaaaccgggtttttcgggacagacaagctttctgcaacactttgcgagagtctctttcgtacaccgacaacctgctcaccgcggtgggccacagtcaaaggagccattcttccaggtctctgtttctcagtgtccattttgttttcgttcgca

SEQ ID NO: 424512 - DNA, 2162 bp, Homo sapiens
ttaatttttcctagttctttaatgagatccctagaaaccgggtttaagacaattgatttttttttttgctttctcggtcagataatttcagaaactccctccctgtgcacctgtgggcattcccacttccacacaccaacaagacaaggttagacagatcttctaaggcagcttctaaggcctttcagcatgtcaaaatgcatctttggggtatccgtttctgagtaccaacaagggaacggaatgggttaagatttcattctctcagtagaggaaaatctagggattcattctacatttgaagccaaaaacagttatctgactccttccagagcctttaaatgttgatcccttcccctcttctcccatcaaacatacacttggaagtttaagaagaatggagggatctcaaggtgtaaagttttctttctgtgcgatgaccagtgctggtcctcggatgtcaactgccaaccagggtagctcatggttacaacctcccgtacagctctcacttatccagaactactgaggctccaagctcagtatcaaactgttcacttgcactatgtcctctatgatgtcactgtcatcatcattttacagacacactgcgactccaagtggtcgttactagttcacaatcaagtagctctcgttcatcttctcgttcatcttcaactctatgattaactgcaaaatgttctgctcattttgactagagtcttgaaagatctgcaaaccgacacggcaggactgatgctcagttctctgaccagggatatccagtctcttatgtggggaaactcacgcccaggtctaacctcacacttttaagacagatgagaaggaagggggaaatgttgctacattaggaggaattaattacaaagagaggaagtaactagcttgatagtctcatggagtcaggattaaacgccatgtctgtcctggcgtacgctaagggatggggaaacgtctgggtcccaggctgggtaaatggcaggcccaagccgaattagttcggctcttggtttgactccctcttccctcctgttccaagcgctcgcatgaacctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccggtccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaggccctcgacatgaatcatatccagtgccttcatgcccctctgctttcctctggccacccttccccttctttcacgtgttccctcgcgttaacagccaccgaatgctaagtgcaagaaagaggccccctatgcattggtcaaatgcgtggggatgaaagccctcgacatgaa

SEQ ID NO: 424513 - DNA, 346 bp, Homo sapiens
cttccctacaaggaaataactctaatgcaaatcaggacgcagatagaggaaactttggttttcttttctttttttcaatttcttactttctttttaaactcatctaagtgggctcaaaagtcttaccaaaatcctgctctacaaggtgttaatgaggtatagtgtgtggtatatggtatgtgaaagagcagttttttttttcttttttgtctgtggggtctttgtccacgtttcacactgtttttaaagagttctgaaatgaattaaagttaactatttttgtggcataagttttgataccagcccttttctttaaagaaagcattatgagataaagtcttgcttt

SEQ ID NO: 424514 - DNA, 590 bp, Homo sapiens
gctagcaccatgagcttcaataccctgtgcctgctactaaatgaattgcggtgggtgaggtggcagctggggacccctctgtcctgtgtcccctgccatgtccctgtctgacccaggcctggggtaccaccccacgtgctggacccgtcgcacccactgcctcttcccttctcgcttgggaactctagtctcgcctcgggttgcaatggaccccaactgctcctgtgccgctgcaggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttgaaaaaaaaaaagtcgacgcggccgcgaatttagtagtagtaggaggcggccgc

SEQ ID NO: 424515 - DNA, 426 bp, Homo sapiens
agcggccgcctactactactaaattcgcggccgcgtcgcacccactgcctcttcccttctcgcttgggaactctagtctcgcctcgggttgcaatggaccccaactgctcctgtgccgctgcaggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 424516 - DNA, 478 bp, Homo sapiens
agcggccgcctactactactaaattcgcggccgcgtcgcacccactgcctcttcccttctcgcttgggaactctagtctcgcctcgggttgcaatggaccccaactgctcctgtgccgctgcaggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttgaaaaaaaaaaagtcgacgcggccgcgaatttagtagtagtaggaggcggccgc

SEQ ID NO: 424517 - DNA, 379 bp, Homo sapiens
agcggccgcctactactactaaattcgcggccgcgtcgacgttgcaatggaccccaactgctcctgtgccgctgcaggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 424518 - DNA, 538 bp, Homo sapiens
gctagcaccatgagcttcaataccctgtgcctgctactaaatgaattgcggtgggtgaggtggcagctggggacccctctgtcctgtgtcccctgccatgtccctgtctgacccaggcctggggtaccaccccacgtgctggacccgtcgcacccactgcctcttcccttctcgcttgggaactctagtctcgcctcgggttgcaatggaccccaactgctcctgtgccgctgcaggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 424519 - DNA, 1352 bp, Homo sapiens
agcggccgcctactactactaaattcgcggccgcgtcgcacccactgcctcttcccttctcgcttgggaactctagtctcgcctcgggttgcaatggaccccaactgctcctgtgccgctggtaagggacgcccgggttctgtgccttgggatgccaaattcccagacaccatagagagtgtccctgggtttgaggaggtcgtattttgctatcagaggtaaaggggactcctttattggtccagtgctttcctgttggccaagctcctgagggcattttcctcctccctgttcctctatgtcagagttgagggtcctgaggctcaaggctgtcctgctccacgtcacctggttggtcacagggctgctggctgagccccaattctctaacctgactctgagctaccggattggataggagacattggataggaggggacattgcctcttccaggttcaggacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcgtgcttctggggaaccggccttcctttgtccctgtaggttgtcactgcctgtctagtcttctgcactttccagggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctctgatcgagtctgctctgacctctcaatctcctttcctccccaggctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 424520 - DNA, 1403 bp, Homo sapiens
  misc_feature (339)..(339): n is a, c, g, or t
aaggctgtacgcgtcggatacgggatgtgtgcccgtcgcacccactgcctcttcccttctcgcttgggaactctagtctcgcctcgggttgcaatggaccccaactgctcctgtgccgctggtaagggacgcccgggttctgtgccttgggatgccaaattcccagacaccatagagagtgtccctgggtttgaggaggtcgtattttgctatcagaggtaaaggggactcctttattggtccagtgctttccgtgtagggcgaagacatctcgtgtagggctgttgtatccttccgtccacatggtatccctctaatgtctagtaggtggtagagganacatgtagcgactcaaagtgactgttacatgagtactctacagtcgactctggatggtgatcatcatgggcatgcttggctgatcctcctgtgcttcataatcatgagtctgagctaccggattggataggagacattggataggaggggacattgcctcttccaggttcaggacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcgtgcttctggggaaccggccttcctttgtccctgtaggttgtcactgcctgtctagtcttctgcactttccagggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctctgatcgagtctgctctgacctctcaatctcctttcctccccaggctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 424521 - DNA, 827 bp, Homo sapiens
cgctggctgttgggctccactccgccttccagtcgcacccactgcctcttcccttctcgcttgggaactctagtctcgcctcgggttgcaatggaccccaactgctcctgtgccgctggtaagggacgcccgggttctgtgccttgggatgccaaattcccagacaccatagagagtgtccctgggtttgaggaggtcgtattttgctatcagaggtaaaggggactcctttattggtccagtgctttcctgttggccaagctcctgagggcattttcctcctccctgttcctctatgtcagagttgagggtcctgaggctcaaggctgtcctgctccacgtcacctggttggtcacagggctgctggctgagccccaattctctaacctgactctgagctaccggattggataggagacattggataggaggggacattgcctcttccaggttcaggacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaa

SEQ ID NO: 424522 - DNA, 292 bp, Homo sapiens
gctgccaggaattcggcacgagaaaactatcagctgacaaccagctcttacacctgctctaccacacaatattattaatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaaaaa

SEQ ID NO: 424523 - DNA, 1624 bp, Homo sapiens
  misc_feature (4)..(4): n is a, c, g, or t
  misc_feature (6)..(6): n is a, c, g, or t
  misc_feature (8)..(8): n is a, c, g, or t
ggcncngncacaaagagcggggcggagaggcagctgcggggggagccggcggccgctgctgccgcccagggctctggggccccgccggccaggcccgccgtccgcggccagtgcccttcctcctcctcctcctctgccgccgcctcctcagtcgccgccgcctcctcagtcgccgccgcccgcgccgcccgcgccctccgcgcgcctctgagcccgcgccgggccgcgccggccccttcccatgcgggcggcgcgggccctgggaggggcgcccggagccagccgcgcagcatgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcaggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaaaaa

SEQ ID NO: 424524 - DNA, 1657 bp, Homo sapiens
gcccccgcctggtggcgtctcctgcccgcagctccgcgccgccccaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactggacgttagcttattgccagtgggtggacaatctcaatgagacccggaagatgctctctcttagtggtggtggtcccttcagcaacctgctgaggtgggttgtgtgccacataacgaaaggaattgtgaaacgcgagatgcacggccacggcattggccgcttctccgaggaagagatttacatgctgatggagaaggacatgcggtctttagcagggcttttgggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaaaaa

SEQ ID NO: 424525 - DNA, 1537 bp, Homo sapiens
ggcggaggcggccggaccgcggagatgcggggagggggcagggcgcggggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactggacgttagcttattgccagtgggtggacaatctcaatgagacccggaagatgctctctcttagtggtggtggtcccttcagcaacctgctgaggtgggttgtgtgccacataacgaaaggaattgtgaaacgcgagatgcacggccacggcattggccgcttctccgaggaagagatttacatgctgatggagaaggacatgcggtctttagcagggcttttgggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaaaaa

SEQ ID NO: 424526 - DNA, 266 bp, Homo sapiens
tcacattgggagtcaggatttcaacattggagttttggggcaacacagaccatagaagtggtagactgctgcctttgagaactaatccttgctttccttaccacactgcaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactca

SEQ ID NO: 424527 - DNA, 2045 bp, Homo sapiens
  misc_feature (4)..(4): n is a, c, g, or t
  misc_feature (6)..(6): n is a, c, g, or t
  misc_feature (8)..(8): n is a, c, g, or t
ggcncngncacaaagagcggggcggagaggcagctgcggggggagccggcggccgctgctgccgcccagggctctggggccccgccggccaggcccgccgtccgcggccagtgcccttcctcctcctcctcctctgccgccgcctcctcagtcgccgccgcctcctcagtcgccgccgcccgcgccgcccgcgccctccgcgcgcctctgagcccgcgccgggccgcgccggccccttcccatgcgggcggcgcgggccctgggaggggcgcccggagccagccgcgcagcatgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactggacgttagcttattgccagtgggtggacaatctcaatgagacccggaagatgctctctcttagtggtggtggtcccttcagcaacctgctgaggtgggttgtgtgccacataacgaaaggaattgtgaaacgcgagatgcacggccacggcattggccgcttctccgaggaagagatttacatgctgatggagaaggacatgcggtctttagcagggcttttgggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaaaaa

SEQ ID NO: 424528 - DNA, 925 bp, Homo sapiens
gacaggtagtgcaatactattaattcccaggccatgctgtcagctcatcagtagagagttgagtggaggtgaagggcatgaggactaacgaggttaatatgaattcaacaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaaaaa

SEQ ID NO: 424529 - DNA, 860 bp, Homo sapiens
agaacaattgctgatattgtggtatgtatgtaatcttttatcaaatgtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaaaaa

SEQ ID NO: 424530 - DNA, 289 bp, Homo sapiens
tagatgtcattcaagcagttaatacagaatcagcaatctaagtccagaagaagagcagggactgtggaaacagagccataaatcctctgcaacaattcagaatgaaactccaaagaaaaagcccaaattggaatctaagccatctaatggagataggtaaaaatgaattcttttagtgttatgaaaattcaacttagttgaatagttatggttgaatgccagttattactagataaaaaaatagaaacatgtattttctacattgacttgagtctgtattaactgctta

SEQ ID NO: 424531 - DNA, 4860 bp, Homo sapiens
atgggaaagggagcggaaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggtccgtgggctccgggaggcgggcgggatgggtgtcctcggccgtagccggagggggccgggtagccgctgcactgcagcccctcttcgccggcgcctcaggggtttgggagtctggagccctcgcctccccactcggggacccctttttctgggggcttgaacattagctgggaacggaccctgaaagggaggcagaatcgtgcccttttccaggcggcccaggagggtgccgggccccgtcagcgtctgggggtctcaggagtggggttgagtgaggcagccacctgtctatgccgcagagacccaggggtggagatgttttcatctcggttttctgcctggtctgtcctcttcttccaccaggaggcaggggacggtttttgcactttcttgctaggaacccgaagccgcaaagctgatggcatccttcttccctgtccaggaaagcgaagcgactggtttgggaacagaatgctctgatttggagctcctcccatcccattaaagcctggatgctgtctgtgagcaacggtgcaaaataataagtagtttcacatttaaccaatccttgaaataggccctgacagctttcttaatttgtctgtaatatacccccacgtctactaaagacaaagacacctgtgccttccctaaggaattatattgtgattggccacttatatgataaagcatccagttctttacgttggggccaggttttataaatgttttagactttcactaggttgggtaaacagttttctaccagaaaagtgagatttgggactttcagaaagatactgactaatgtattgtcttattacaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgtttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagtatttcaatg

SEQ ID NO: 424532 - DNA, 4032 bp, Homo sapiens
atgggaaagggagcggaaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgtttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagtatttcaatg

SEQ ID NO: 424533 - DNA, 4783 bp, Homo sapiens
atgggaaagggagcggaaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggtccgtgggctccgggaggcgggcgggatgggtgtcctcggccgtagccggagggggccgggtagccgctgcactgcagcccctcttcgccggcgcctcaggggtttgggagtctggagccctcgcctccccactcggggacccctttttctgggggcttgaacattagctgggaacggaccctgaaagggaggcagaatcgtgcccttttccaggcggcccaggagggtgccgggccccgtcagcgtctgggggtctcaggagtggggttgagtgaggcagccacctgtctatgccgcagagacccaggggtggagatgttttcatctcggttttctgcctggtctgtcctcttcttccaccaggaggcaggggacggtttttgcactttcttgctaggaacccgaagccgcaaagctgatggcatccttcttccctgtccaggaaagcgaagcgactggtttgggaacagaatgctctgatttggagctcctcccatcccattaaagcctggatgctgtctgtgagcaacggtgcaaaataataagtagtttcacatttaaccaatccttgaaataggccctgacagctttcttaatttgtctgtaatatacccccacgtctactaaagacaaagacacctgtgccttccctaaggaattatattgtgattggccacttatatgataaagcatccagttctttacgttggggccaggttttataaatgttttagactttcactaggttgggtaaacagttttctaccagaaaagtgagatttgggactttcagaaagatactgactaatgtattgtcttattacaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgtttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttactaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagtatttcaatg

SEQ ID NO: 424534 - DNA, 3794 bp, Homo sapiens
tacggagggtcgggcctcctccagtaagaagcgtgggcgagtagtggtgtcgccagtggcaactgaagggagtaatggagataaaacaaaagcgaaggcgaagttaaagcactccacgagttccctcggattaaacgccggagagagcgtgaatttgcctcggggacgcctctccaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgtttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagtatttcaatg

SEQ ID NO: 424535 - DNA, 3741 bp, Homo sapiens
atgggaaagggagcggaaggaagcggatccacggccgcacagctaaacagcaaccccctacccgcttcgtctccctccgccgctatcggggcctaagcgggagcggctggcacggcgtcactgggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgtttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagtatttcaatg

SEQ ID NO: 424536 - DNA, 3431 bp, Homo sapiens
tagaggttcccgcccgctcggacacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgtttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagtatttcaatg

SEQ ID NO: 424537 - DNA, 2346 bp, Homo sapiens
atgggaaagggagcggaaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggtccgtgggctccgggaggcgggcgggatgggtgtcctcggccgtagccggagggggccgggtagccgctgcactgcagcccctcttcgccggcgcctcaggggtttgggagtctggagccctcgcctccccactcggggacccctttttctgggggcttgaacattagctgggaacggaccctgaaagggaggcagaatcgtgcccttttccaggcggcccaggagggtgccgggccccgtcagcgtctgggggtctcaggagtggggttgagtgaggcagccacctgtctatgccgcagagacccaggggtggagatgttttcatctcggttttctgcctggtctgtcctcttcttccaccaggaggcaggggacggtttttgcactttcttgctaggaacccgaagccgcaaagctgatggcatccttcttccctgtccaggaaagcgaagcgactggtttgggaacagaatgctctgatttggagctcctcccatcccattaaagcctggatgctgtctgtgagcaacggtgcaaaataataagtagtttcacatttaaccaatccttgaaataggccctgacagctttcttaatttgtctgtaatatacccccacgtctactaaagacaaagacacctgtgccttccctaaggaattatattgtgattggccacttatatgataaagcatccagttctttacgttggggccaggttttataaatgttttagactttcactaggttgggtaaacagttttctaccagaaaagtgagatttgggactttcagaaagatactgactaatgtattgtcttattacaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtgtatgtaatgtgtgccattagtaaggtaatttgccagttgcatccatttctgtcagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaagagtcaaatttgagaacaaaaatgaacgttcaatttctacacttcccagaaccaatttgatggtatctgctttctaacaattttttactggctcttcatcagtatatgtgataaaacaaaatcctcttctttcatttgtttttgtgtgtagaaattgaa

SEQ ID NO: 424538 - DNA, 1153 bp, Homo sapiens
atgggaaagggagcggaaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagataggtaaaaatgaattcttttagtgttatgaaaattcaacttagttgaatagttatggttgaatgccagttattactagataaaaaaatagaaacatgtattttctacattgacttgagtctgtattaactgctta

SEQ ID NO: 424539 - DNA, 245 bp, Homo sapiens
caagcagttaatacagactcattaaacatagccataaatcctctgcaacaattcagaatgaaactccaaagaaaaagcccaaattggaatctaagccatctaatggagataggtaaaaatgaattcttttagtgttatgaaaattcaacttagttgaatagttatggttgaatgccagttattactagataaaaaaatagaaacatgtattttctacattgacttgagtctgtattaactgctta

SEQ ID NO: 424540 - DNA, 302 bp, Homo sapiens
ttgctttacactagaagtattgacccccttaaagctaatactgaattatatttctgcaggtgtatgtaatgtgtgccattagtaaggtaatttgccagttgcatccatttctgtcaggtacatatttttttgcattagccttaaggatgtttgtggaattgtctaatttatgcaatttgaacacctgctaattttccttctacttcatttaactgtgttttacttttttctttttagtagctctataaatcagtcagcagatagtgggggaacagacaattttgtccttataagtcaattga

SEQ ID NO: 424541 - DNA, 727 bp, Homo sapiens
cccacatcttggttaggtctggaagattttaagcactatgaaggcttgtctgctgagaacctagctgggcttcagagccgatgtcctttgatacacagggaaatttgacaccaccctcacctccaggccccaaaaggcctgagtctgggaccccagtcacctcggtacccaagctcctgactcttacctcagtcccaaccccttgacaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaacc

SEQ ID NO: 424542 - DNA, 480 bp, Homo sapiens
cccacatcttggttaggtctggaagattttaagcactatgaaggcttgtctgctgagaacctagctgggcttcagagccgatgtcctttgatacacagggaaatttgacaccaccctcacctccaggccccaaaaggcctgagtctgggaccccagtcacctcggtacccaagctcctgactcttacctcagtcccaaccccttgacaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagaggcagctgcgcctgtacgccatccagagtactgccc

SEQ ID NO: 424543 - DNA, 697 bp, Homo sapiens
gagtccgcctcagactcagagctgcgctcctcgacctcaacgccaggcggttactttgctgctcctcccgctcgctatgtcaacgtccactagctgcccgattcccgggggccgggaccagctgcccgactgctacagcaccacgccggggggcacgctatacgccactacccccggaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaacc

SEQ ID NO: 424544 - DNA, 1316 bp, Homo sapiens
tgcttgatagacactggaaagcagaataatgcttaactaccttttttttgctgcttattttataaattaatctttgttaagagatttctgacatcatcagcatcacatcatatgtttcctttcagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 424545 - DNA, 2241 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 424546 - DNA, 2631 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtctattgctgttgtacacttcttttatctaacgtatatttttatagtgtcatataccagccccctaacctgccccacctgtcccctttttaaaaacatattttccagttacatagcactgaggtactctatttggtgtagatcaacaataaacataagagcctactgtatattaggtactgatataattgattaatcatctggcaccagctcaataacctgtttttgccgtgttctttatagtttatcaggggatttgaaaattacctcaaagtatgttaaaaccagcctggctgaaagcactgatacctttatgttgccaaacccagtgtacaattttctcacctaatcttatacaccctattcattatactctgatgaaaacatttgatttc

SEQ ID NO: 424547 - DNA, 2187 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 424548 - DNA, 2292 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 424549 - DNA, 2131 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 424550 - DNA, 2113 bp, Homo sapiens
aaaaactgctgaattgtttactttaaaaggtaaactttatgatatgtgaattatatcttaagaaaactgttattctaaaaaaataaattctttaaggtacatctcagtgcttcttcctttatgtaacttttccttatctgtctttgacgttttcttcctcttatactccatagcacttttgagcagcttgaataggactttatagtctgccttttataggataattattagcatgtcttgtttccccaccctcctcctttaattgcagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaagtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 424551 - DNA, 1388 bp, Homo sapiens
ttctctatagcacgggaaccgttatgtgaacatgtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctctgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 424552 - DNA, 1330 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccaggtatggcatatttatcatcaaggacaggagcttggaaaattatcactggtaaatttttttcctagttacaaacatcatgtgtgagcatttccccatattattacatattcttcaaaaccaaagttcctggttgctgcatatattcatttatttaaccattccttattattggacatccaggtttattattttttcagtgctataaataagattgcaataagtgcaaatgtccttattttagaaatctctgggcatattactgattattttcctaggataa

SEQ ID NO: 424553 - DNA, 953 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgattttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttgggtaagcttggtccaaaacacttaattttataaaggaaatgtatgtggtttgtt

SEQ ID NO: 424554 - DNA, 419 bp, Homo sapiens
ggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaagtaactaaacaggagcccacaagacggtctgccagattgtcagcgaaacctgctccaccaaaacctgaacccaaaccaagaaaaacatctgctaagaaagaacctggagcaaagatt

SEQ ID NO: 424555 - DNA, 325 bp, Homo sapiens
atttaatccacgcaacaaccctttgatggaggtttacagttatccccattttctaggtgaggaaactgaggctcagtgaagttagtgacctgtctgaggatgcaaacccaggcacccacaatggcaaccactgcagtgttctgctactggaaacagtgcagcacaaaggtgcataagaatctgaaagctgtggataaagttaaggcaacagaatcctcactttttagagcaaagatgaactatataatcttctgttttaggtgaagattctgaggatgattctgattttgtgagagtgaggataatgacgaagacttctctatga

SEQ ID NO: 424556 - DNA, 367 bp, Homo sapiens
gagagaagaaggcagcaggggccacttcaagcttccctgcttcctaagcttaggttgtcagaagcctttttagagatacatttttagaaaaagaaaaatagtgtggtaacagtttactacttgcttctttttttttgtttgtttagagtattttatagtaatattactatagctttatgtctagcttaccaaataaggggtgaagtgtgccccagagaacgctgttactgtagaaacgtgtcttagccccaatttccactcattggatacaatgagtgatcaagcactcgaggctctgtcggcttcactgggcacccggcaagcagaacctgagctcgacctccgctcaattaaggaagtcgatgag

SEQ ID NO: 424557 - DNA, 2570 bp, Homo sapiens
tactttgggtgtgtttcaaatattagtctgatttttgcttgagaaaatatttgtattgatatgtaagtttgcatttgactacattggtaaggtgttttcccccattgaaactaatattttctattttcaagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacc

SEQ ID NO: 424558 - DNA, 354 bp, Homo sapiens
  misc_feature (42)..(42): n is a, c, g, or t
  misc_feature (50)..(50): n is a, c, g, or t
tttaatagaaattttttttttccccctttttttgccccgggnaaaagggnaaaccttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacatta

SEQ ID NO: 424559 - DNA, 562 bp, Homo sapiens
  misc_feature (450)..(450): n is a, c, g, or t
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtcagttctctgggcancagaagtcttcagttgaatcacagaaccaagctgtaaaacagacctgaaagaatacagtcaacaactgtctgtggtatgagaaaatccagaggaagcaagacacacaagcaa

SEQ ID NO: 424560 - DNA, 820 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtcagtgatttcctgaacacgaaaagacccctactgtattctacagggatatgattagtgggtggggcctgtaggaatggcaaacagtgtccagatatcactgaaggttttttaacaaagtatcatttctgtgctagaagagagaatataatttcttaataatgatgtgaatgatttaaaacctagtaaaaccatttattgtataaatcttcttggcatataataagcgttaaataaatattaattattatgatgactatctgcagataatattaaacttttgaacatactgtgagtaaaaacgtagtgctcccactttagaaaataattcatatcctcctcatgggcattaaccacaccaggcgtgctgctagtgctttatgtaat

SEQ ID NO: 424561 - DNA, 590 bp, Homo sapiens
tactttgggtgtgtttcaaatattagtctgatttttgcttgagaaaatatttgtattgatatgtaagtttgcatttgactacattggtaaggtgttttcccccattgaaactaatattttctattttcaagaaaaaagcagcaagcctcggcagcagtcaatcctccagaacctatgctggtggaacagcctcggccaccaaggtcagtgatttcctgaacacgaaaagacccctactgtattctacagggatatgattagtgggtggggcctgtaggaatggcaaacagtgtccagatatcactgaaggttttttaacaaagtatcatttctgtgctagaagagagaatataatttcttaataatgatgtgaatgatttaaaacctagtaaaaccatttattgtataaatcttcttggcatataataagcgttaaataaatattaattattatgatgactatctgcagataatattaaacttttgaacatactgtgagtaaaaacgtagtgctcccactttagaaaataattcatatcctcctcatgggcattaaccacaccaggcgtgctgctagtgctttatgtaat

SEQ ID NO: 424562 - DNA, 678 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagatgtagaggaattacaggaccaaaagttgcatggactaacaagccaaagataaaataactagagaggaggaaaaagaaaaatgaaaacacttaacatcagcaactttaaatgcagtagaacaaataagtctttccaaacctgcaatcaaatctatttaaaggatgaaactgacacatccggccacactgagagagtgtgaatcttttagcaacatatttcagtaaagtcctggggaatggaatttaaagtataaaacgggcatgatctcagagagccaattttaaaagcttcaaatttaacaatggatttattttta

SEQ ID NO: 424563 - DNA, 965 bp, Homo sapiens
  misc_feature (932)..(932): n is a, c, g, or t
tgggagtgcagatatctttataaggtgataatttcatctcctttgggtatatacccagaagagggattactgggtcatacagtagttctacttttaatttctttaggaacctatatactgttttccatcatagcccataccaatctacatccccactgacagtgtactagggttcccttttctccacacccttgccgacatttattatctattgacaagctctgttttgattagcaaaataaggtctgggtgagtcaggcaccacgggaattagagcatcaatgtcacccacatttccctccttatttctatcctttttccctcctgctttaaacaattctctgacaccgttgttcaaaaaaaatcatgaaaaaacacccaaagtcttccattatttaattaaattggagatctcagaatggtctggattaatttaactgcagcctagttaattgctagatggattggtgatagccatagcctcattacatttcctttgctttaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaaaaaaaaaaaaaaaaaaaaaaaaaaaaaaaaaaaaaaaaaaaaaaaaaaaaaaaaaaaaaaaaaaaaaaaanaaaaacaaaaaaaaaaaaaaaaaaaagaacaaa

SEQ ID NO: 424564 - DNA, 2330 bp, Homo sapiens
  misc_feature (151)..(151): n is a, c, g, or t
atgcaagattaattcacagtcgattaaaaatcactgagcactactcaacaaagcacatcaataattttactaattgttcaaatcattaatcctaaaggagctcatcatgatagctccactaaaaacagaccttctacaacagcgaagccanctgttaaccattactcttacccttgtcctgacccaaaatcatctcttctgtcttcacctgccttggaaatgcaacatctccactgaatatttgattcagacttggctctttaagaacaatttctgtgcaataagtagcacaatacagggataggaaaacaggtttatcctactaacttgatttgagcaaatgatttaacttctatggaagccagtctcctcatttgtaaaatgaagagcagtggtgaaggatgtagttatataatgcaggtaaagtgcaaagccccaaacccagcatgtatcagggacttaacctcatccatttgttcaccaatatttactctgatatttattcatccctctgctgtaattactgtgctagacactgaggatgcagcagtgaatcaggcaagcatcctcccctcatggagcttacagtcttttggggtatacaagcagtaaatatgattactgtaaataaactgctatgaagaaaatatgccaggggtatgctagtaactgaggagatgtggcctgcattgaacagcatggttttggggaaggtgatctgagccgagacctctcaaagataaaatgcccctttctagtgaaaagttggggaatgggcaagccaggcagagagaataaaaagtgcagaggcttaaagacaggagaaacatgtggtagcccaggagcagaaggaggctgagtggctacagtgttatgagagagtaagccaggagcgcctgtgggaattggcaccagagaggtcctcagaagccaggtcttcaaggtcatggacacatgggaaggagggatttggaatttactgcaagaacaataggcagggtttcaagaagccagggtcagttatgggctgacttgcagtcttcaatgtggaaaatgttttgctattggcaaagtggcaagggggaggccagttaggacactattgcaataggcaaggcaagagatgagaaaggattgaatgggggtaagagcagagagaagtgcgcaagatccagtgcatgtgctgagggaagaccggcaggacttgcgtagttagatgtctggggaagaaaggattcaggatgactcccgtattttatatgtccgtagtttgctctccattatgataacatctcgggctctttacttttcatgccctgcttcaggatcttcgcacctgatatttcctctgcacacaatactcctctagatgttggcatttccttcgatatcttctcaaatgtctcctaatcatcctataaaacagcaccaaccctctatcccaatcactctccttgccttattcatcttcagagcatgtaactacttgacattggttgatttgtctgtaattgtctgattcccacagcagaaatttcagctccgtgacagcaaaggttttgtctgtctgttcactgttacagccccataacctaaaaccatgtgtggcatatatgtcttgaatgaattaatgagaatacaagtgaatgaatgaaatgctttgttgctatagatcttgtctatagatgactacctttctggtcaaggctttggacatctcttcagtcatcagacagagtatctctgctctagacctcgctggagttcaagcttgaattattatatgcaagttaattttacaagcctggatgaggctactgaaaactggaaaaaagctacgagactgtaacaacccttcattctttttcatttccaaagctctctccccatctcaagctagaaaatagtgtaaccagactacacaatggaaccactcctaaaaaaattaatattagcctctcagcttttatctaaatgtaccacagtttaagagccttgtaaaatttgttccacaactttactataggaaaccttattatagaagggacaccacagaactcaatggcccacacatcaaagtcctcgagtttaggactgaagaaaagtctgcttttgtagaaaatgtgtatgcttcatgttctcttttaccagacaatgagaataactcatactgattcctcatttttccttgacttccaggaatgtctgtgataaattcaggggacaattgcgagaattatcctcagccataagtccctcacatggttatcacctgtccattatgtatctttttgtccttcattttaacatttcttttatacatggatctt

SEQ ID NO: 424565 - DNA, 1802 bp, Homo sapiens
tgctgtcacttcctgttctgagtcatcagggaaggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggt

SEQ ID NO: 424566 - DNA, 333 bp, Homo sapiens
ggtataatttttctcaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctctttctttaaattttgaaggattgctaaaactttgctggctggccattctcttgaaggtggtttccccaaaaaccccaggcaccaagaagggtacccgagtctccgaattcc

SEQ ID NO: 424567 - DNA, 2270 bp, Homo sapiens
agaacatagggtactccgagtgaagaattcagcagctaagtggaagttgtcttctattccactttaaatacttttatctactgaatcgcaagaaaattgggtttctggtgctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacc

SEQ ID NO: 424568 - DNA, 5328 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424569 - DNA, 5385 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424570 - DNA, 4540 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacatta

SEQ ID NO: 424571 - DNA, 5346 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424572 - DNA, 5133 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424573 - DNA, 5451 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424574 - DNA, 5076 bp, Homo sapiens
cagcgatacggcccggaagttcgggatgcgaggactgcggggtccggtgtcacgcagagtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424575 - DNA, 5221 bp, Homo sapiens
tactttgggtgtgtttcaaatattagtctgatttttgcttgagaaaatatttgtattgatatgtaagtttgcatttgactacattggtaaggtgttttcccccattgaaactaatattttctattttcaagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424576 - DNA, 5071 bp, Homo sapiens
  misc_feature (3)..(3): n is a, c, g, or t
gtngcactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424577 - DNA, 5014 bp, Homo sapiens
  misc_feature (3)..(3): n is a, c, g, or t
gtngcactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424578 - DNA, 5394 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424579 - DNA, 5054 bp, Homo sapiens
  misc_feature (13)..(13): n is a, c, g, or t
  misc_feature (15)..(15): n is a, c, g, or t
cggctgctcgcgngngccagtgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424580 - DNA, 5313 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424581 - DNA, 5151 bp, Homo sapiens
agcgaaatgtttctttttaagggtttgctaattattatataacataaaaaaaaaacccacacatgtgggccaaatgcatccacaggccccagtatgtgactctgaaggaaccaaatgatggccccatgccaggagcagtcccattgggaagcacagtcccttctgttccaaatccagaatggccactgaaagaccccaccattttcttgtgggtggtagggggatcaaatcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424582 - DNA, 5032 bp, Homo sapiens
  misc_feature (3)..(3): n is a, c, g, or t
gtngcactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424583 - DNA, 4535 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatcctcccccctctccgtgggagcgccgtgtggggccgtcggcggggggagaaggg

SEQ ID NO: 424584 - DNA, 4898 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcatttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424585 - DNA, 4240 bp, Homo sapiens
  misc_feature (4123)..(4123): n is a, c, g, or t
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggganctttttatggctaccacaccgagataaagcctataagacccttttaaaggacggaattccttaaaaaatctgcaggggggggcccacacggggagaaaccctctcgggacgaaagac

SEQ ID NO: 424586 - DNA, 5163 bp, Homo sapiens
  misc_feature (4626)..(4626): n is a, c, g, or t
  misc_feature (4631)..(4631): n is a, c, g, or t
  misc_feature (4664)..(4664): n is a, c, g, or t
  misc_feature (4693)..(4693): n is a, c, g, or t
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaagatgcaaacttcgttttttaaaaacatgatatctaaaaagcagaatgtgcagagtcttttctttgccaagcaaaacagtttccaccacgacggagtcttgctctgtcacccaggctggagtgccgtggctcgatatcggttcctgcaagctccgccctcccgggttcacgccattctcctacctcagcctcccgagtagctgggactacaggcgcccgccaccatgcccggctcattttttgtattttagtagagacggggtttcaccgtcttagccaggatggtcttgatcccctgacctcgtgatccacccacctcagcctcccaaagtgctgggattacaggcgtgagccaccgcgcctgtgctaaaatatattttctagagtgggattagctgtcaacaaactcagtagtcacatggctcatgtgttatctgtgtacatttgtgaaaaacaacagtaatttagagacatacgtgtatttgaaaatattattcagatgaaatactgaatttttcattattctgataatcaccattctcagagactgctgacagggttactattgacctgataccacatgtctacttctgtgatcctaaagagtgggcctgagtgggcctaagcgggcttttcctgaaaaaggcagaatgttttagtggaattctgttcttgtccttgtttgaaagtattacaagttggattccagtgtaatcaagtttaatcttttgaaattgacagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagngctgntccacccaagagaagaaaagaaaggtggagaangatacaatgagtgatcaagcactcgaggntctgtcggcttcactgggcacccggcaagcagaacctgagctcgacctccgctccattaaggaagtcgatgaggcaaaagctaaagaagaaaaactagagaagtgtggtgaggatgatgaaacaatcccatctgagtacagattcaaaccagccacggataaagatggaaaaccactattgccagagcccctatattaggccataaaacaagaattaatataattaaaaggatttaaaccataccaagtatattctctaactaggatggactcaaattaccaagccaccatataaggaaatttgaagaatccagtatgtagaaactgaataacacatgcgtaacccatccatgagtccaaggggatgtcagaaaattaaaacacagcaggccatcgcggtggctatacacctgtaatcccagcactttgggagccgaggcgggcggatcacctgaggcgaagttcgagac

SEQ ID NO: 424587 - DNA, 4289 bp, Homo sapiens
  misc_feature (3752)..(3752): n is a, c, g, or t
  misc_feature (3757)..(3757): n is a, c, g, or t
  misc_feature (3790)..(3790): n is a, c, g, or t
  misc_feature (3819)..(3819): n is a, c, g, or t
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagngctgntccacccaagagaagaaaagaaaggtggagaangatacaatgagtgatcaagcactcgaggntctgtcggcttcactgggcacccggcaagcagaacctgagctcgacctccgctccattaaggaagtcgatgaggcaaaagctaaagaagaaaaactagagaagtgtggtgaggatgatgaaacaatcccatctgagtacagattcaaaccagccacggataaagatggaaaaccactattgccagagcccctatattaggccataaaacaagaattaatataattaaaaggatttaaaccataccaagtatattctctaactaggatggactcaaattaccaagccaccatataaggaaatttgaagaatccagtatgtagaaactgaataacacatgcgtaacccatccatgagtccaaggggatgtcagaaaattaaaacacagcaggccatcgcggtggctatacacctgtaatcccagcactttgggagccgaggcgggcggatcacctgaggcgaagttcgagac

SEQ ID NO: 424588 - DNA, 5423 bp, Homo sapiens
  misc_feature (2349)..(2350): n is a, c, g, or t
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaaccggcagatgaccnngaccccattgatgctcttactgcagaggaccaggctggatgagtagttgctcgcacttacatgaacaactcaaaaaagacaggagaaggatcaggtggtagagggctgcattccaaggattcgcagatagtgcacgtgacgaaatgggggtcatattccgaagaggttctgcaagcggacgaatcacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424589 - DNA, 5365 bp, Homo sapiens
  misc_feature (2291)..(2292): n is a, c, g, or t
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaaccggcagatgaccnngaccccattgatgctcttactgcagaggaccaggctggatgagtagttgctcgcacttacatgaacaactcaaaaaagacaggagaaggatcaggtggtagagggctgcattccaaggattcgcagatagtgcacgtgacgaaatgggggtcatattccgaagaggttctgcaagcggacgaatcacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424590 - DNA, 3283 bp, Homo sapiens
  misc_feature (74)..(74): n is a, c, g, or t
  misc_feature (79)..(79): n is a, c, g, or t
  misc_feature (86)..(86): n is a, c, g, or t
  misc_feature (91)..(91): n is a, c, g, or t
ctgctgccgtccctcttcagcaagaaaagtggtggtgggatggtaggcagtgtggacccatatgaaacaaaccnatggnagataangtaanggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424591 - DNA, 3106 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacacactgagacttgaatcaagtcagcaacagagcaaaataaagatgcaaacttcgttttttaaaaacatgatatctaaaaagcagaatgtgcagagtcttttctttgccaagcaaaacagtttccaccacatgtgtgctgacttgcagtatgttcccagcaggataggcaattcctggccaagaaaacaaaaatagatgccagaatgatctaatctaatctaatttcccttggccacatgaacatgaatgaatgacggactcacca

SEQ ID NO: 424592 - DNA, 3218 bp, Homo sapiens
tataagagaaacagcgcctggggtgaccgtgcgtactgaatagatccagatggtgttctgatgtcatcttagagttatcgtatcttacatcacgtgaggtccatagctgagactcggatatcaacattagccgcgccgcctatgaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424593 - DNA, 2770 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctacgtctaggtcggggagcctctagtgtcgaccgct

SEQ ID NO: 424594 - DNA, 2802 bp, Homo sapiens
  misc_feature (2769)..(2769): n is a, c, g, or t
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcaccaaaaaaaaaaaaaaaaaaaaaaaaaaaaaaaaaanaaaaacaaaaaaaaaaaaaaaaaaaagaacaaa

SEQ ID NO: 424595 - DNA, 1812 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttggtgagtgactccctgggcatttgagcagtggcttgagaaagttttctgcctcctcctgtcactctctgctgtgtattaccatcattttatcttatcctgacaaattaaaaataaaatctgatatcattata

SEQ ID NO: 424596 - DNA, 1688 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagtatgtttctaaacatataaatctctagttttgaggtttgtgatcttaaaaaaaaattgtgagacagactgttttagcatcaagcagtctgttagaaagccca

SEQ ID NO: 424597 - DNA, 1357 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgag

SEQ ID NO: 424598 - DNA, 419 bp, Homo sapiens
gcggccgcagcggcctcgccatgtcccagcccggccagaagcccgccgcctccccgcggccccggcgagcagccgccgcccgccgcacccatgaggtgagtggcgctcctgtcggcgtcgcggggctgggcgatggggtaccgggtcccggagctgtggccgccctccctgggcgttgccaggctggcgggtctgcagtccccggcgcccccgcggggcagggagagggctaggggcttggccgctgccaggcaggtggctgcaggtggcttcggttccccggccgggtccagtgcgctgggcgtggcgttggccgggtagagtggagggggggacgcgtcaagaaaagttggctggtaagacgtgggtgaatgaggatgaggatgaacggggaatgaggttcactcaggacccccgag

SEQ ID NO: 424599 - DNA, 363 bp, Homo sapiens
agtgggagttcctacaacgatcagccattgtgccttgagagaagaaggcagcaggggccacttcaagcttccctgcttcctaagcttaggttgtcagaagcctttttagagatacatttttagaaaaagaaaaatagtgtggtaacagtttactacttgcttctttttttttgtttgtttagagtattttatagtaatattactatagctttatgtctagcttaccaaataaggggtgaagtgtgccccagagaacgctgttactgtagaaacgtgtcttagccccaatttccactcattggtaagttctttttcctttctctcttttgcaaggtttcaaataaaattgcctttctagagcac

SEQ ID NO: 424600 - DNA, 380 bp, Homo sapiens
gctatattaggtagaactgctctaacatttttcccaaaattaaaaaaaattctattaatccactttcatgtttacttataggaaattccttctgtctgttatacaatgcttttgctaagtggtatatttactatgtctgtaacaagaaaattacatattaaatgattcactgcattttttatttgaaatttttaaggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgta

SEQ ID NO: 424601 - DNA, 519 bp, Homo sapiens
gagccccaccccgtgatacctcggtaagcagcacatcttatttgggagataaatgtttttgcgcagccacaactagaaagaaaatagggcgcctgtttaaagcaaatgaaaataggcagaattattaggaagatcaggcaccttctatttcagaagagccgagactgatgatttagcgagatggcagagattaactttgaaatgattaaatgaaactatatatgtgaaaacattgtacacatagtcaaggaccttaatattattgttgctttataagaattgaaagtgcaataaagtgcattgtgtctatattcaaattactagatttgaaaagttctttagctttcctgataattgattttctcctttatattttttcttatacattctataatttactacccattatttaacctcaagtttattttatggaatcgtcatgtttgagcttttacaaacattttacaaacgtcatggaatagcattgttttcttcccaattcacaccagtaaaaatttg

SEQ ID NO: 424602 - DNA, 3271 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggt

SEQ ID NO: 424603 - DNA, 6427 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagggtaaatggagcagtaaatatactacaaattagtttagcagttacacagagtagggtttatcatttcagtcatttagtttcctactggaatctatttagaataaaatttcttaaagtactatctatcccatagcatcgcttggtaaagtaattgaatttgtataaatacatatatttttaagtaactggtgctttaaaatcctaaatgaatgttcttgacacaacccaatttgcctgtgttttgcctgtctttcttgccctaattaaaataccaccatagtatgtggtttatatagattttagaacatggaagttggaaacttcctattattaaaattactcaagctgtgatgagaaatgaaaattggattagacaacttctaggtcccttccaattccaagaacatatgatttaaatgattattactatgatcccctggctataaggaggagttaaaggtgtagctttaaagacaatagtccagttacaccaaagcttttaaaacaatatattaaaatcttcctgtagtagattcccttaagggatataggaaacagcattgataattggcagttatgccattatatctcagtttaaatacttatttgcctattatttaatttcagttatacgaagtacttaatcagccctttaacaaataatagaaagcataataaccctttatgatgagtggatttactggacagccatgaccctatgtacaggaaaggaaggatcaccacagaatgaaacattgccatttaagaacacctatgcatattttataacctaccctagccttaaaaaaataaagctgagagtgatacatttaggatcaggatcacttaaggttatttttagcttataagcttgaggaggaagaactcacaatattgtggccagatgaagaagagaaactgaaaggaccatcttatttttccccactgactgccatcttttgtcccctaattctgagaaggccatctcctcatacttaatacagaaaagaaagctcacggatggttttgctttcccttttagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424604 - DNA, 3638 bp, Homo sapiens
gtggtgttctagaggatcccgtctacatagtgttaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424605 - DNA, 3628 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacacactgagacttgaatcaagtcagcaacagagcaaaataaagatgcaaacttcgttttttaaaaacatgatatctaaaaagcagaatgtgcagagtcttttctttgccaagcaaaacagtttccaccacatcttgtctatagatgactacctttctggtcaaggctttggacatctcttcagtcatcagacagagtatctctgctctagacctcgctggagttcaagcttgaattattatatgcaagttaattttacaagcctggatgaggctactgaaaactggaaaaaagctacgagactgtaacaacccttcattctttttcatttccaaagctctctccccatctcaagctagaaaatagtgtaaccagactacacaatggaaccactcctaaaaaaattaatattagcctctcagcttttatctaaatgtaccacagtttaagagccttgtaaaatttgttccacaactttactataggaaaccttattatagaagggacaccacagaactcaatggcccacacatcaaagtcctcgagtttaggactgaagaaaagtctgcttttgtagaaaatgtgtatgcttcatgttctcttttaccagacaatgagaataactcatactgattcctcatttttccttgacttccaggaatgtctgtgataaattcaggggacaattgcgagaattatcctcagccataagtccctcacatggttatcacctgtccattatgtatctttttgtccttcattttaacatttcttttatacatggatctt

SEQ ID NO: 424606 - DNA, 2695 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacc

SEQ ID NO: 424607 - DNA, 3129 bp, Homo sapiens
gcgcgaattcatcatcctgctgcgcgaattcatcatcctgctgcgcgaattcatcatcctgctagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttc

SEQ ID NO: 424608 - DNA, 2064 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggtaagatggaaagccactcctgcccaaaagagtcttaggaacagcgttccacccatgagtgaagacttccctctggatgcttgtcgtgacgacttctctggtcccaatgcgtctctcttaattgaagaatgttaatgtgtggtgccactcttagtgggttccccaccccgtttagaccaatgggcccccgggaaccg

SEQ ID NO: 424609 - DNA, 1318 bp, Homo sapiens
aggagcccgggtccctccgcgggcaggaaggggagggcccatcggggctaggggaaccccggcgcagacctggggtggggtcggaaaagctgtttcatcgcccgctcccgggccctccgctcctcctgcctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgag

SEQ ID NO: 424610 - DNA, 499 bp, Homo sapiens
tttttattgtctgcatggtctaaataagctcttagaacagggcctaactcatagtaagcactgaagaaatgttagccattgttgttagttaacaattgtttcattgcagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttca

SEQ ID NO: 424611 - DNA, 4448 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424612 - DNA, 3115 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttca

SEQ ID NO: 424613 - DNA, 3421 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctg

SEQ ID NO: 424614 - DNA, 3735 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctgtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424615 - DNA, 2870 bp, Homo sapiens
cttgtgatccacccgcctcgacctcccgaagtgctgggattacaggcgtgagccaccgcacctggccgtgattatcttcttgatgatgttcttgacaattcacatattatggggtctttgtgaatgtaggcagtaaggaacctttgaatagtggttgtacatacagtttttcagagctggtgtttaataacaatatttttcattctaatattacattattctttttatcatttaggtctttatccgtcagtgtttttagagaactactgcacttgaccacaaactgataaatacttggtactgccccatctcactgttctgtttactttgtcttaaatatctctttttttttttttcccaggcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424616 - DNA, 2582 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatggcaagtggcatttgttttattgagcttttattgtatggatgtgggtttttcatacatttatggcacttactgtgtgagttcaacaaattaacctttctgtgcctgtttccttatccataaaacagggttaatacctacctca

SEQ ID NO: 424617 - DNA, 2186 bp, Homo sapiens
cgtctaatccacccaagattgccgccgttgtcccccccgggcccttttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424618 - DNA, 2392 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagtaagtcctcttaattcacctttggtggtgatgatttatgtgagagttctctcccttctctttttggattgtcctatttcaactaacttgagaaacctgctgatatgaaataggtcatggaaataaacccttaaccttttcccctttttaacattcttagattgataaaagtttatcactttcttgttaaaaataactgggtaccacatgtgaagaggattgctgaatccatgcagaatgggtaagtggtgtgtagacaggatgctccctctacagactaagattccagcctgtgtgcatcagtaccaccatcaaacataaacccctgacctcatctcatacctggcagctactgactaagtaactaaagtttcttgctttatagataaagagaaattatcgaagattctagtgtcccactttgtatctctctgtggtatcctcctactccac

SEQ ID NO: 424619 - DNA, 1832 bp, Homo sapiens
tttttattgtctgcatggtctaaataagctcttagaacagggcctaactcatagtaagcactgaagaaatgttagccattgttgttagttaacaattgtttcattgcagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424620 - DNA, 1308 bp, Homo sapiens
tgcctcccggattcaagcagttctctgcctcagcctcccgagtggctgggattacaggtgcccaccaccacgtccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424621 - DNA, 4482 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggcatgagatgtatgtctgtgaagtacctgaaacataaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424622 - DNA, 3481 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctg

SEQ ID NO: 424623 - DNA, 4080 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacatttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424624 - DNA, 2627 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaaggtaattctaatattaataatagttggcgttacagaacactttctatacattgtcttacctaatcatcagaagactattttggagctagtactatggaagtaaaaacaaagtggaagaattcttcagcatttttttgtgggtcacataactagtgacaaaacatagatttacctcctgcctcctgttttcaaaaagttaacatggaaagataactgggaagacattctttgaatatgagcaatttcttcttgtatattataattatactacgaaaaattgagttaatgatacaattaaacttgaacttgaaatttttttcc

SEQ ID NO: 424625 - DNA, 2344 bp, Homo sapiens
gcctggtggcgaattcggcacgaggcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactgtatcccaagcttgccctagtacttcttgttctttttggaagtattcttttaaatacggactacctcagatatgcttacctacaaaatacatgttaaataacccta

SEQ ID NO: 424626 - DNA, 2190 bp, Homo sapiens
tcttatagtatgtctccagtcacacgcagaagcagctacgcgaaccttatttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccctttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgccttt

SEQ ID NO: 424627 - DNA, 1344 bp, Homo sapiens
actactactactaaattcgcggccgtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaacc

SEQ ID NO: 424628 - DNA, 265 bp, Homo sapiens
agatatataggggaatgggccttagtgcatgctccggcgcatgggggcggggaattcgattagcctaaatgtttatttcattggtcagtgtcagaactaggattggaatttagattgttaatctcttgccacaagataggaaaatggagcaagatgaggagaaaaaagcatttaatgggagagaacatttggactcaatcactagtgaattcgcggccgcctgcaggtcgaccatattgggagagctcccaacgcgttggatgca

SEQ ID NO: 424629 - DNA, 267 bp, Homo sapiens
cctgatcactatggggaattgggcgatgtgcatgtccggcgcatgggggcgggtgaatcgattagcctaaatgtttatttcattggtcagtgtcagaactaggattggaatttagattgttaatctcttgccacaagataggaaaatggagcaagatgaggagaaaaaagcatttaatgggagagaacatttggactcaatcactagtgaattcgcggccgcctgcaggtcgaccatattgggagagctcccaacgcgttggatgca

SEQ ID NO: 424630 - DNA, 3218 bp, Homo sapiens
  misc_feature (3034)..(3034): n is a, c, g, or t
tggcctcgaactcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggctttgaatcttgatggggtggcggaggcccctggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccagtctgggcaacagagtgagattccgtctcaagaaaaaaacacagggacatgggaaacaaaatatagctttattacctattncctgggtttagagcgggcatggaaatttgtggaacagtccaaattacagtggaataatacaatacaaaatttataagtatagataattagatttctaatagtaataagtaaactttcaaaaaggccgggggtctatcaatttactaaagagggtacaaattaagggagttcacttaacacatat

SEQ ID NO: 424631 - DNA, 2567 bp, Homo sapiens
tggcctcgaactcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggctttgaatcttgatggggtggcggaggcccctggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaacc

SEQ ID NO: 424632 - DNA, 3108 bp, Homo sapiens
  misc_feature (2924)..(2924): n is a, c, g, or t
tggcctcgaactcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggctttgaatcttgatggggtggcggaggcccctggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagcctgggcaacagagtgagattccgtctcaagaaaaaaacacagggacatgggaaacaaaatatagctttattacctattncctgggtttagagcgggcatggaaatttgtggaacagtccaaattacagtggaataatacaatacaaaatttataagtatagataattagatttctaatagtaataagtaaactttcaaaaaggccgggggtctatcaatttactaaagagggtacaaattaagggagttcacttaacacatat

SEQ ID NO: 424633 - DNA, 3187 bp, Homo sapiens
  misc_feature (3003)..(3003): n is a, c, g, or t
tggcctcgaactcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggcggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccagtctgggcaacagagtgagattccgtctcaagaaaaaaacacagggacatgggaaacaaaatatagctttattacctattncctgggtttagagcgggcatggaaatttgtggaacagtccaaattacagtggaataatacaatacaaaatttataagtatagataattagatttctaatagtaataagtaaactttcaaaaaggccgggggtctatcaatttactaaagagggtacaaattaagggagttcacttaacacatat

SEQ ID NO: 424634 - DNA, 2529 bp, Homo sapiens
tggcctcgaactcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggctttgaatcttgatggggtggcggaggcccctggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacatttggactcaatcactagtgaattcgcggccgcctgcaggtcgaccatattgggagagctcccaacgcgttggatgca

SEQ ID NO: 424635 - DNA, 1995 bp, Homo sapiens
  misc_feature (1811)..(1811): n is a, c, g, or t
actactactactaaattcgcggccgtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccagtctgggcaacagagtgagattccgtctcaagaaaaaaacacagggacatgggaaacaaaatatagctttattacctattncctgggtttagagcgggcatggaaatttgtggaacagtccaaattacagtggaataatacaatacaaaatttataagtatagataattagatttctaatagtaataagtaaactttcaaaaaggccgggggtctatcaatttactaaagagggtacaaattaagggagttcacttaacacatat

SEQ ID NO: 424636 - DNA, 956 bp, Homo sapiens
  misc_feature (772)..(772): n is a, c, g, or t
cctgatcactatggggaattgggcgatgtgcatgtccggcgcatgggggcgggtgaatcgattagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccagtctgggcaacagagtgagattccgtctcaagaaaaaaacacagggacatgggaaacaaaatatagctttattacctattncctgggtttagagcgggcatggaaatttgtggaacagtccaaattacagtggaataatacaatacaaaatttataagtatagataattagatttctaatagtaataagtaaactttcaaaaaggccgggggtctatcaatttactaaagagggtacaaattaagggagttcacttaacacatat

SEQ ID NO: 424637 - DNA, 619 bp, Homo sapiens
acaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccagtctcacccaggctggagtgcagtggcacgatctcgcctcactgcaacctccgcctcccaggttcatgtgattctcctgcctcagcctcctgagtagctgggattacaggcatatgccaccatgcctggctaatttttgtatttttagtagagatggggtttcaccatgttgatcaggctggtctggaactactgacctcaggccacccgccttggcctcccaaagtgctgggattacaggcatgagccaccgcgcccagctaatttttgtatttttattttatttatttattt

SEQ ID NO: 424638 - DNA, 2380 bp, Homo sapiens
  misc_feature (2196)..(2196): n is a, c, g, or t
tgcaagagcttgttgcttgaagccctgcttttccaaaaagtgggccactctggtcctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcgaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccgttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccagtctgggcaacagagtgagattccgtctcaagaaaaaaacacagggacatgggaaacaaaatatagctttattacctattncctgggtttagagcgggcatggaaatttgtggaacagtccaaattacagtggaataatacaatacaaaatttataagtatagataattagatttctaatagtaataagtaaactttcaaaaaggccgggggtctatcaatttactaaagagggtacaaattaagggagttcacttaacacatat

SEQ ID NO: 424639 - DNA, 1974 bp, Homo sapiens
cggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgataaaaaaaaaaacgtgt

SEQ ID NO: 424640 - DNA, 526 bp, Homo sapiens
tgataagcctaggaatgccagagcccagctgtagggtcccagtccctgggtgtgaggggttcctgccccaggggtgaggcctactgccagctaaatctctcctctctcgtcgcacggaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgataaaaaaaaaaacgtgt

SEQ ID NO: 424641 - DNA, 1679 bp, Homo sapiens
cggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgataaaaaaaaaaacgtgt

SEQ ID NO: 424642 - DNA, 1888 bp, Homo sapiens
cggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgataaaaaaaaaaacgtgt

SEQ ID NO: 424643 - DNA, 2003 bp, Homo sapiens
cggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgaggtcctcagttcaattccagagatgttggggcttgggttggggagggaggtgaatcccagagggagcaagtgtcctcactgaaggcactgatagaccctccccatctctccctcagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgataaaaaaaaaaacgtgt

SEQ ID NO: 424644 - DNA, 1976 bp, Homo sapiens
ttcagggacctccagcagagaagggtcactaggatacaatgtggcatgcatgagctaaaaacagaagtgatttaactctcagagggaaaatggatcagataacacttcatggagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacaagatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcacgaaagacactggaagagctgtattcctacttatccttaaaggaaagaaactgcccttgaattccaaggacctgattactggagctggaattccaaataatgtgtcccagtgagactcctgggggtagttttgtccggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttattaattcatttaaaatacatcagtgcgggccgggtgtggtggctcacacttataatcccaacactttggaaggccaaggcgggaggatcacttgaagccacaaatttaagaccagcctggataatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaagcaactataggttagcagttgctccagaatctccaaaacaagcttaggagatttttattctttaccagaaatgagatggcttgggaggaaggtgtgtgcattacacacaggttgctctgtggtcactgctccttcatactgtgtttctgcctctgcctgaacccaaacccctcccagcctgacagaaatgttcgcttacgcagctaggccctgcctcagtttgtacatctacctgtcggctgagacat

SEQ ID NO: 424645 - DNA, 1802 bp, Homo sapiens
ttcagggacctccagcagagaagggtcactaggatacaatgtggcatgcatgagctaaaaacagaagtgatttaactctcagagggaaaatggatcagataacacttcatggagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacaagatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcacgaaagacactggaagagctgtattcctacttatccttaaaggaaagaaactgcccttgaattccaaggacctgattactggagctggaattccaaataatgtgtcccagtgagactcctgggggtagttttgtccggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttattaattcatttaaaatacatcagtgcgggccgggtgtggtggctcacacttataatcccaacactttggaaggccaaggcgggaggatcacttgaagccacaaatttaagaccagcctggataatatagcgagaccctgtctctacaaaaaaaataaataaagaaaaaataaataccaagttatgagtgtcagagcaggggagccctccacgcagccacggagccagtctgagggaagaggtacataggatagaaaaatctctaggctccaacgcttctgcttcggtgtctttccatttcccagggtctatgtgttgccttctcttcattttccagcaaaattccttttgagatatgttggccttcactcggctgaactagggggtgaaggaaggttgtcctctgtgggccactattgctggggaaacagctaaaccctgtaggccaagtggaacttggaggtgccaagaaa

SEQ ID NO: 424646 - DNA, 280 bp, Homo sapiens
tctcaaactcctgacctcaggtgatccgcctacctcccaaggtgctgggattaaaggcgtgagccaccgcgcctagcatatgtttatttttaatttagaactcatcgtggcttgtctatatacattgaaataatgatgtgacacacaaactgttgtgaaaaatgtcagttactttgaatgtaagcattttttccaaaatcacttatgtgtctaaaccaattccttctataaatcagtaagaaaatgataaaacaattcaacaggaaaatgaacaaaggcc

SEQ ID NO: 424647 - DNA, 2690 bp, Homo sapiens
tctcattggagacaaaaacttgtcatctggctttgtagagaaggttgcaccttacgctcataatagattatctttactatgggctagggtatcatatttatttatttatttatttttatttttttattattatactttaagttttagggtacatgtgcacaacgtgcaggtttgttacatatgtgtacagggtatcatatttaaaaggacaaaaaaaaagcaacgtcaaatacttgaatgagcttgtattataacattaatattattgaaggtatctgctttccaggccaaattgattcatttattattatagtcctgctttagtcctttgtactttgtggtaattatgctttccttttcaataccaaaaaaaaaagtgtataaaaataaaaacttgggccaggcccagtggctcaagcctgtaataccagcactttgggaggccaaaccctgtgatgccgtgttgaataggagtactttctcaccacacttgtcttccttccgcctctatgggaatccttccaaaacggcaccattaagtgttatactcgctgtagctcctccttatgaagttctcttctcattgtagtctgttaagtgtttatgattaaagagtgttatattttgttaaatgctttcgcagtatctttggagatgatcatgttttttctttattaatctcttttttattttatttattttattttattttattttattttttattattttagtttttattttgagatggaatctcactctgtctcccaggctggagtgcagtgccctgatctaagctcattacaacctctacctcccaggttcaagcgattcttctgcctcactttcccaagtaacagggactacaggtgcgtgccaccacatctggctaagttttgtattatcagaagaagataggccgccattggccaggctggccttgaactcctgacattaagtgatccacctgcctcagcctcctaaagtgctaggaatacaggcgtgagccactgctctgggccttcctttattaatttcttaaactggcagatttagaatactaaacttccttctattcttagaataaaccctatataatcagctatttatttaaataacatggtctctgcaatttctcctggtttccattttttctcataataggcatttttttctaaaaaacaaaaatgaatgttcattagtgagacaaaactataattttgtttttttcttctttctctcttccttcctttttaaaatttgtattctccagttttgctaataatgttatacaattttacaagaaaaaagtgagtaggagagctgtttttctatagtaacagattctgtgaaataggtatcatgccaggtgaggtggcacgtccctgtagtcccagctactcaggaggtgaagcagaaggaccacttgagcccaggaattggagactgtagtgtgctgccatcatgcctgtgtatagcttctgcgctacagcctaggcaacgtagcgagaaccatctcagaaaaaaaaaaaaaaaaaaagagataatctattcctcataaattcactaaaacttggaatatctgaccggacttggcagcatttgggtggaaggacgtagaaaatattttttaactgcctaccttattttcataatcataatttgtttagtcagcttgtctattttcttctttttcttgaaaattattttccactgagtttaattttttgtaaaagttacacagcattctcttgtcattctttatatctccctttttgtagttatgttccttaatttctgtaactttctgaaaccagggttaatttgttttgaaattgtccaacgtgtgctttgaaaaaaagaagggatgttttctgtgtcaaatgaaggtaatcatagatcaaatttgcttattgtcttgttcaaatcctagaaaaccattagcatttttctttgcttgtaatatgagaatctaacactcatacagaatattgaaaggttaccctacaattgtaaatttgaaattctccttctaattctgtcagttatttattgacatagtagtggttctgtagtcaagtgcatataaggttttgaatgttacatcttatttttggatttttattttatcattatggagtatagcaaagttctattttgttctttttcaaatgtacttggttttgattatcccttggtccttgattgttttattattctattttttatttcattaaactttcagtaaatagtgatttttatagtctgtatctaatcatttcaatatctgaaatcctttgtttgcctagggatctaggaggaaatagaaggctctttgcttataagccaaactctccatagtgtctgtttttcttcgattttgtgacatttgttatgaacttatatttaaacatcctaagttcctgacagagtgtctggcatataataggtgttcagtaaatgattgctccataaatagataatgtgtgtagatgtagagaacttgggttcaagatactttcttcctgtagggatttgttttgtcttcatcaggcacaagggggcactataagcccgagtcagtttaatttcaggccttcttcactggaactcaagacttcatttatacttagggttaaatctttggggccaattttctccatccacctcctcagagtcagagtcctgta

SEQ ID NO: 424648 - DNA, 2398 bp, Homo sapiens
attgcccactaattccaattcttatttgatctaattgtttatagattcttgtgaacttttaccttgacaattatgttattttcaaagataatcatcttttcctattgaatccttgctcttctgactgcctgttcctatctcatggtattggccaaaccctgtgatgccgtgttgaataggagtactttctcaccacacttgtcttccttccgcctctatgggaatccttccaaaacggcaccattaagtgttatactcgctgtagctcctccttatgaagttctcttctcattgtagtctgttaagtgtttatgattaaagagtgttatattttgttaaatgctttcgcagtatctttggagatgatcatgttttttctttattaatctcttttttattttatttattttattttattttattttattttttattattttagtttttattttgagatggaatctcactctgtctcccaggctggagtgcagtgccctgatctaagctcattacaacctctacctcccaggttcaagcgattcttctgcctcactttcccaagtaacagggactacaggtgcgtgccaccacatctggctaagttttgtattatcagaagaagataggccgccattggccaggctggccttgaactcctgacattaagtgatccacctgcctcagcctcctaaagtgctaggaatacaggcgtgagccactgctctgggccttcctttattaatttcttaaactggcagatttagaatactaaacttccttctattcttagaataaaccctatataatcagctatttatttaaataacatggtctctgcaatttctcctggtttccattttttctcataataggcatttttttctaaaaaacaaaaatgaatgttcattagtgagacaaaactataattttgtttttttcttctttctctcttccttcctttttaaaatttgtattctccagttttgctaataatgttatacaattttacaagaaaaaagtgagtaggagagctgtttttctatagtaacagattctgtgaaataggtatcatgccaggtgaggtggcacgtccctgtagtcccagctactcaggaggtgaagcagaaggaccacttgagcccaggaattggagactgtagtgtgctgccatcatgcctgtgtatagcttctgcgctacagcctaggcaacgtagcgagaaccatctcagaaaaaaaaaaaaaaaaaaagagataatctattcctcataaattcactaaaacttggaatatctgaccggacttggcagcatttgggtggaaggacgtagaaaatattttttaactgcctaccttattttcataatcataatttgtttagtcagcttgtctattttcttctttttcttgaaaattattttccactgagtttaattttttgtaaaagttacacagcattctcttgtcattctttatatctccctttttgtagttatgttccttaatttctgtaactttctgaaaccagggttaatttgttttgaaattgtccaacgtgtgctttgaaaaaaagaagggatgttttctgtgtcaaatgaaggtaatcatagatcaaatttgcttattgtcttgttcaaatcctagaaaaccattagcatttttctttgcttgtaatatgagaatctaacactcatacagaatattgaaaggttaccctacaattgtaaatttgaaattctccttctaattctgtcagttatttattgacatagtagtggttctgtagtcaagtgcatataaggttttgaatgttacatcttatttttggatttttattttatcattatggagtatagcaaagttctattttgttctttttcaaatgtacttggttttgattatcccttggtccttgattgttttattattctattttttatttcattaaactttcagtaaatagtgatttttatagtctgtatctaatcatttcaatatctgaaatcctttgtttgcctagggatctaggaggaaatagaaggctctttgcttataagccaaactctccatagtgtctgtttttcttcgattttgtgacatttgttatgaacttatatttaaacatcctaagttcctgacagagtgtctggcatataataggtgttcagtaaatgattgctccataaatagataatgtgtgtagatgtagagaacttgggttcaagatactttcttcctgtagggatttgttttgtcttcatcaggcacaagggggcactataagcccgagtcagtttaatttcaggccttcttcactggaactcaagacttcatttatacttagggttaaatctttggggccaattttctccatccacctcctcagagtcagagtcctgta

SEQ ID NO: 424649 - DNA, 1952 bp, Homo sapiens
agactcgaattgactagtgtctttttgaaaaaagaaaaagaggccaggcacagtggctcacgcctgtaatcccagcactttgggaggctgaggcaggcggatcacctgagctcaggagttcgagaccagcctggccaatatggtgaaaccccatctctactaaaaatacaaaaatcatccaggcatggtggcatgcacctgtaatctcaactactcaggaggctgaggcaggagaatcgcttcaacccaggaggcagaggttgcattgagccaagatcacgcaattgtcctccagtctgggcaacaagagtgaaactccatgtttaacgtcggcccggcgcgcgcgtccgggaggttgcccgtaggccgctaactggtggttcccagtccccgccgactcggcctctttcttctgcggccaccagatcgcgggatatcggagacttcgaacaatccgctggagtcctttacagtttaaaaacagaggaccggccgggcgcggtggctcacgcctgtaatcccagcactttgggaggccgaggcgggcggatcacgagttcaggagatagagaccatcctggctaacaccgtgagaccccgtccctatcaaaagtacaaaaaaattagccgggtgtggtggcacgcgcctgtagtcccagctactcaggaggtgaagcagaaggaccacttgagcccaggaattggagactgtagtgtgctgccatcatgcctgtgtatagcttctgcgctacagcctaggcaacgtagcgagaaccatctcagaaaaaaaaaaaaaaaaaaagagataatctattcctcataaattcactaaaacttggaatatctgaccggacttggcagcatttgggtggaaggacgtagaaaatattttttaactgcctaccttattttcataatcataatttgtttagtcagcttgtctattttcttctttttcttgaaaattattttccactgagtttaattttttgtaaaagttacacagcattctcttgtcattctttatatctccctttttgtagttatgttccttaatttctgtaactttctgaaaccagggttaatttgttttgaaattgtccaacgtgtgctttgaaaaaaagaagggatgttttctgtgtcaaatgaaggtaatcatagatcaaatttgcttattgtcttgttcaaatcctagaaaaccattagcatttttctttgcttgtaatatgagaatctaacactcatacagaatattgaaaggttaccctacaattgtaaatttgaaattctccttctaattctgtcagttatttattgacatagtagtggttctgtagtcaagtgcatataaggttttgaatgttacatcttatttttggatttttattttatcattatggagtatagcaaagttctattttgttctttttcaaatgtacttggttttgattatcccttggtccttgattgttttattattctattttttatttcattaaactttcagtaaatagtgatttttatagtctgtatctaatcatttcaatatctgaaatcctttgtttgcctagggatctaggaggaaatagaaggctctttgcttataagccaaactctccatagtgtctgtttttcttcgattttgtgacatttgttatgaacttatatttaaacatcctaagttcctgacagagtgtctggcatataataggtgttcagtaaatgattgctccataaatagataatgtgtgtagatgtagagaacttgggttcaagatactttcttcctgtagggatttgttttgtcttcatcaggcacaagggggcactataagcccgagtcagtttaatttcaggccttcttcactggaactcaagacttcatttatacttagggttaaatctttggggccaattttctccatccacctcctcagagtcagagtcctgta

SEQ ID NO: 424650 - DNA, 1229 bp, Homo sapiens
tctcattggagacaaaaacttgtcatctggctttgtagagaaggttgcaccttacgctcataatagattatctttactatgggctagggtatcatatttatttatttatttatttttatttttttattattatactttaagttttagggtacatgtgcacaacgtgcaggtttgttacatatgtgtacagggtatcatatttaaaaggacaaaaaaaaagcaacgtcaaatacttgaatgagcttgtattataacattaatattattgaaggtatctgctttccaggccaaattgattcatttattattatagtcctgctttagtcctttgtactttgtggtaattatgctttccttttcaataccaaaaaaaaaagtgtataaaaataaaaacttgggccaggcccagtggctcaagcctgtaataccagcactttgggaggccaaaccctgtgatgccgtgttgaataggagtactttctcaccacacttgtcttccttccgcctctatgggaatccttccaaaacggcaccattaagtgttatactcgctgtagctcctccttatgaagttctcttctcattgtagtctgttaagtgtttatgattaaagagtgttatattttgttaaatgctttcgcagtatctttggagatgatcatgttttttctttattaatctcttttttattttatttattttattttattttattttattttttattattttagtttttattttgagatggaatctcactctgtctcccaggctggagtgcagtgccctgatctaagctcattacaacctctacctcccaggttcaagcgattcttctgcctcactttcccaagtaacagggactacaggtgcgtgccaccacatctggctaagttttgtattatcagaagaagataggccgccattggccaggctggccttgaactcctgacattaagtgatccacctgcctcagcctcctaaagtgctaggaatacaggcgtgagccactgctctgggccttcctttattaatttcttaaactggcagatttagaatactaaacttccttctattcttagaataaaccctatataatcagctatttatttaaataacatggtctctgcaatttctcctggtttccattttttctcataatgaacattcatttttgttttttagaaaaaaatgcctattatgagaaaaaagtcaacgcggccgcgaat

SEQ ID NO: 424651 - DNA, 341 bp, Homo sapiens
gaggtcctagatatcttccaaagacatcccaacagctaaacaataagtgatattccatataatttcccatatatcatgacatctttattaggaaattgtgttttaatgtatctgtgaaagtcctttatgattctcatagataatggtagaaaaactgtcagaaatgtttgttaaatgaatagacaagagagagaatgagaaaggagagagagagaaggaaagaaggggataaagaattgagaagagtgctactaaccaggctaagattatggaataagaaagattttatagactcaaaattatcctggtagtcaacagtccattccaataagccagcgtct

SEQ ID NO: 424652 - DNA, 513 bp, Homo sapiens
caaacaatctcattatatttctaaagaaatatgtttccacatcataagaactggggaaacttaggatacaatcaataattctttattttaagaaagcatactgtcaagataagttattacatgaagataatgattttaaaccacataatattggttgatttggatccttaatcaataaaaattagcaaatctatttaaatgataatcagagctcctagattagaaataattttgatgaagcggtcctttaaagtaaatgccagacatgattgaaaatgtcacaaaaggaatcggaatttcctcctgatgcccaacctgacagtacgacttgcccaggaattacacattcttattgagaggagagtggagccagataggcacagacatttctgcaaatttatatgactcttttcagtttttaacagtaagactggtaagcatttctatattaaaaaatgtcttaaggaaaaataaaattttattccagatacttatgtttcatcattagagcta

SEQ ID NO: 424653 - DNA, 3258 bp, Homo sapiens
tttggtgctatgtaattgtaattaatttcatgtcattttcattgctttatttcctcaacatggtacctacatcacagggcttttgtaagaattaaatgagataacatagataaaagtaaagcaatcatttttaaagttcggttttaaaaacccacccacttttgcaaatcagactctgtgtttttaatcagacagttgaaactagggcagttgaccgttggggcacttgatttgctaaacgaaatctctcagtcttgtgaagtgggaaccatgtgaccctctgactcaggttttgtgttcttcctagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaaaaaa

SEQ ID NO: 424654 - DNA, 3116 bp, Homo sapiens
  misc_feature (14)..(14): n is a, c, g, or t
  misc_feature (27)..(27): n is a, c, g, or t
  misc_feature (48)..(48): n is a, c, g, or t
  misc_feature (65)..(65): n is a, c, g, or t
  misc_feature (98)..(98): n is a, c, g, or t
  misc_feature (128)..(128): n is a, c, g, or t
  misc_feature (153)..(153): n is a, c, g, or t
  misc_feature (179)..(179): n is a, c, g, or t
  misc_feature (187)..(187): n is a, c, g, or t
ctaatgccaaaggnctcattcaattantcgaattttgaaggcatggtnggcctcttgtattacantgcaaagggattctgaagcattagttggtagcnaggttttcaagttacgacgttgtaaacganggcaagtgcaacttaaattaccctnactaaagggaataactttcggccgcntgcagggncctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggactctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaaaaaa

SEQ ID NO: 424655 - DNA, 3113 bp, Homo sapiens
  misc_feature (14)..(14): n is a, c, g, or t
  misc_feature (27)..(27): n is a, c, g, or t
  misc_feature (48)..(48): n is a, c, g, or t
  misc_feature (65)..(65): n is a, c, g, or t
  misc_feature (98)..(98): n is a, c, g, or t
  misc_feature (128)..(128): n is a, c, g, or t
  misc_feature (153)..(153): n is a, c, g, or t
  misc_feature (179)..(179): n is a, c, g, or t
  misc_feature (187)..(187): n is a, c, g, or t
ctaatgccaaaggnctcattcaattantcgaattttgaaggcatggtnggcctcttgtattacantgcaaagggattctgaagcattagttggtagcnaggttttcaagttacgacgttgtaaacganggcaagtgcaacttaaattaccctnactaaagggaataactttcggccgcntgcagggncctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataatgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaaaaaa

SEQ ID NO: 424656 - DNA, 2334 bp, Homo sapiens
  misc_feature (14)..(14): n is a, c, g, or t
  misc_feature (27)..(27): n is a, c, g, or t
  misc_feature (48)..(48): n is a, c, g, or t
  misc_feature (65)..(65): n is a, c, g, or t
  misc_feature (98)..(98): n is a, c, g, or t
  misc_feature (128)..(128): n is a, c, g, or t
  misc_feature (153)..(153): n is a, c, g, or t
  misc_feature (179)..(179): n is a, c, g, or t
  misc_feature (187)..(187): n is a, c, g, or t
ctaatgccaaaggnctcattcaattantcgaattttgaaggcatggtnggcctcttgtattacantgcaaagggattctgaagcattagttggtagcnaggttttcaagttacgacgttgtaaacganggcaagtgcaacttaaattaccctnactaaagggaataactttcggccgcntgcagggncctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagctctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagaggga

SEQ ID NO: 424657 - DNA, 1531 bp, Homo sapiens
tttggtgctatgtaattgtaattaatttcatgtcattttcattgctttatttcctcaacatggtacctacatcacagggcttttgtaagaattaaatgagataacatagataaaagtaaagcaatcatttttaaagttcggttttaaaaacccacccacttttgcaaatcagactctgtgtttttaatcagacagttgaaactagggcagttgaccgttggggcacttgatttgctaaacgaaatctctcagtcttgtgaagtgggaaccatgtgaccctctgactcaggttttgtgttcttcctagtggaaggagcctgggagaggccaggcctccccggactgctagcctgcttttcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagaggga

SEQ ID NO: 424658 - DNA, 1967 bp, Homo sapiens
  misc_feature (14)..(14): n is a, c, g, or t
  misc_feature (27)..(27): n is a, c, g, or t
  misc_feature (48)..(48): n is a, c, g, or t
  misc_feature (65)..(65): n is a, c, g, or t
  misc_feature (98)..(98): n is a, c, g, or t
  misc_feature (128)..(128): n is a, c, g, or t
  misc_feature (153)..(153): n is a, c, g, or t
  misc_feature (179)..(179): n is a, c, g, or t
  misc_feature (187)..(187): n is a, c, g, or t
ctaatgccaaaggnctcattcaattantcgaattttgaaggcatggtnggcctcttgtattacantgcaaagggattctgaagcattagttggtagcnaggttttcaagttacgacgttgtaaacganggcaagtgcaacttaaattaccctnactaaagggaataactttcggccgcntgcagggncctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagctcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagaggga

SEQ ID NO: 424659 - DNA, 3167 bp, Homo sapiens
  misc_feature (14)..(14): n is a, c, g, or t
  misc_feature (27)..(27): n is a, c, g, or t
  misc_feature (48)..(48): n is a, c, g, or t
  misc_feature (65)..(65): n is a, c, g, or t
  misc_feature (98)..(98): n is a, c, g, or t
  misc_feature (128)..(128): n is a, c, g, or t
  misc_feature (153)..(153): n is a, c, g, or t
  misc_feature (179)..(179): n is a, c, g, or t
  misc_feature (187)..(187): n is a, c, g, or t
ctaatgccaaaggnctcattcaattantcgaattttgaaggcatggtnggcctcttgtattacantgcaaagggattctgaagcattagttggtagcnaggttttcaagttacgacgttgtaaacganggcaagtgcaacttaaattaccctnactaaagggaataactttcggccgcntgcagggncctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaaaaaa

SEQ ID NO: 424660 - DNA, 2393 bp, Homo sapiens
  misc_feature (14)..(14): n is a, c, g, or t
  misc_feature (27)..(27): n is a, c, g, or t
  misc_feature (48)..(48): n is a, c, g, or t
  misc_feature (65)..(65): n is a, c, g, or t
  misc_feature (98)..(98): n is a, c, g, or t
  misc_feature (128)..(128): n is a, c, g, or t
  misc_feature (153)..(153): n is a, c, g, or t
  misc_feature (179)..(179): n is a, c, g, or t
  misc_feature (187)..(187): n is a, c, g, or t
ctaatgccaaaggnctcattcaattantcgaattttgaaggcatggtnggcctcttgtattacantgcaaagggattctgaagcattagttggtagcnaggttttcaagttacgacgttgtaaacganggcaagtgcaacttaaattaccctnactaaagggaataactttcggccgcntgcagggncctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagaggga

SEQ ID NO: 424661 - DNA, 2633 bp, Homo sapiens
  misc_feature (14)..(14): n is a, c, g, or t
  misc_feature (27)..(27): n is a, c, g, or t
  misc_feature (48)..(48): n is a, c, g, or t
  misc_feature (65)..(65): n is a, c, g, or t
  misc_feature (98)..(98): n is a, c, g, or t
  misc_feature (128)..(128): n is a, c, g, or t
  misc_feature (153)..(153): n is a, c, g, or t
  misc_feature (179)..(179): n is a, c, g, or t
  misc_feature (187)..(187): n is a, c, g, or t
ctaatgccaaaggnctcattcaattantcgaattttgaaggcatggtnggcctcttgtattacantgcaaagggattctgaagcattagttggtagcnaggttttcaagttacgacgttgtaaacganggcaagtgcaacttaaattaccctnactaaagggaataactttcggccgcntgcagggncctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctttggggtcacccccaactagtattatccgctcttttctttgattttccgattcttctcactgtgctttcacataattttgttttt

SEQ ID NO: 424662 - DNA, 358 bp, Homo sapiens
gccaggatggtctcgatctcctgaactcgtgatccgcctgccttggcctcccaaagtgctgggattacaggcgtgagccattgtgcctggcccaaatgtcttattcataccaataatttattgaaattaaaaatatgctattcttttttctttggagtccatactttgaatgattttattgatcagacaatatttattaagtgaagtaatttgttatctccgttttttttttttagacagttcttgctctgttgcccagctatccacccacctcagcctcctgagtagctaggactataggcacgtgccaccatgcctggctaattaaaatttttctttgtagagacaggggtctcac

SEQ ID NO: 424663 - DNA, 1440 bp, Homo sapiens
cacttaaaaagcttggcctctagattctttgtctcagagccctctgggctctctcctctgagggagggacctttctttcctcacaagggacttttttgttccattatgccttgttatgcaatgggctctacagcaccctttcccacaggtcagaaatatttccccaagacacagggaaatcggtcctagcctggggcctggggatagcttggagtcctggcccatgaacttgatccctgcccaggtgttttccgaggggcacttgaggcccagtcttttctcaaggcaggtgtaagacacctcagagggagaactgtactgctgcctctttcccacctgcctcatctcaatccttgagcggcaagtttgaagttcttctggaaccatgcaaatctgtcctcctcatgcaattccaaggagcttgctggctctgcagccacccttgggccccttccagcctgccatgaatcagatatctttcccagaatctgggcgtttctgaagttttggggagagctgttgggactcatccagtgctccagaaggtggacttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatgtcagagtgggggcagcttatgccacctgagtcctcctcaaccacggaaaactatttcagggtagccacaagtgatccagagggctgcacttctctaaccatgttgctaacctggtcattccactctgggttcctgaaatgccatttcagacatgttgaaacaatgtaggctcagtactcagtgaacacggaattctcttgtgaattgcaaagagtgctgaatttgtactttagaaggcttgaaatcctggctccaccacttctgcagcctttagtttcatctttctgagtcctagtttccttatcggtaaaatggggataaatgctacttcactgggtttttgcaggtattaaatgaaggggtagacttaaaactgctttctaaactataaagccttatactctttaggatggtgttattcttatcttagtggtatgatgaccttctgcaagatgtcttttaaagtttttttctgaga

SEQ ID NO: 424664 - DNA, 1277 bp, Homo sapiens
acgacacatgaaacctggccttaaccttgtttccttgtttataacttggagtcctggcccatgaacttgatccctgcccaggtgttttccgaggggcacttgaggcccagtcttttctcaaggcaggtgtaagacacctcagagggagaactgtactgctgcctctttcccacctgcctcatctcaatccttgagcggcaagtttgaagttcttctggaaccatgcaaatctgtcctcctcatgcaattccaaggagcttgctggctctgcagccacccttgggccccttccagcctgccatgaatcagatatctttcccagaatctgggcgtttctgaagttttggggagagctgttgggactcatccagtgctccagaaggtggacttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatgtcagagtgggggcagcttatgccacctgagtcctcctcaaccacggaaaactatttcagggtagccacaagtgatccagagggctgcacttctctaaccatgttgctaacctggtcattccactctgggttcctgaaatgccatttcagacatgttgaaacaatgtaggctcagtactcagtgaacacggaattctcttgtgaattgcaaagagtgctgaatttgtactttagaaggcttgaaatcctggctccaccacttctgcagcctttagtttcatctttctgagtcctagtttccttatcggtaaaatggggataaatgctacttcactgggtttttgcaggtattaaatgaaggggtagacttaaaactgctttctaaactataaagccttatactctttaggatggtgttattcttatcttagtggtatgatgaccttctgcaagatgtcttttaaagtttttttctgaga

SEQ ID NO: 424665 - DNA, 1031 bp, Homo sapiens
agaactctgcccaggacagcaggtgcctgctggctctgggtttggaagttggggtgggtagggggtggtaagtactatatatggctctggaaaaccagctgctacttccaaatctattgtccataatggtttctttctgagcttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatgtcagagtgggggcagcttatgccacctgagtcctcctcaaccacggaaaactatttcagggtagccacaagtgatccagagggctgcacttctctaaccatgttgctaacctggtcattccactctgggttcctgaaatgccatttcagacatgttgaaacaatgtaggctcagtactcagtgaacacggaattctcttgtgaattgcaaagagtgctgaatttgtactttagaaggcttgaaatcctggctccaccacttctgcagcctttagtttcatctttctgagtcctagtttccttatcggtaaaatggggataaatgctacttcactgggtttttgcaggtattaaatgaaggggtagacttaaaactgctttctaaactataaagccttatactctttaggatggtgttattcttatcttagtggtatgatgaccttctgcaagatgtcttttaaagtttttttctgaga

SEQ ID NO: 424666 - DNA, 157 bp, Homo sapiens
caaataattatacaaataaatatgcatacttaatatatttcctagtttctaagttgtactttctcatttttcacatttttgaaatttaggtgcaattttataatcaatgattaaatttaataaagtgtttctcttctcccatgaaacaaccataatt

SEQ ID NO: 424667 - DNA, 2666 bp, Homo sapiens
caaagtgtctagtagacagataaaaaaatagactagttctagatcgcgagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424668 - DNA, 625 bp, Homo sapiens
gactttttccttctccttctgcagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattgctacacggtctctcatccgtgttgcaatgtcattaaggagagaaggaagagaagtaagccgagggcgtctttgattgtgtagtaagggtggaaggtgatttatcggaatgggaggtgattcctagggggttgtttgatcccgtttcgtgcaagaataggaggtggagtgctgctagggctgcatcaatgcaggtcactggctgttaggctaggttgcgtggattagcatgccctcctctt

SEQ ID NO: 424669 - DNA, 2690 bp, Homo sapiens
aggcgagcaggggactgggaggggctgcgagaggcgcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggtccttggccttgctggtggggcttttgtttccatagcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424670 - DNA, 2863 bp, Homo sapiens
caaagtgtctagtagacagataaaaaaatagactagttctagatcgcgagcggcccccggaggctttcctggtagaagttgatgcgaggaagggcggcggggaccaggtttgcgagtcctaggcgagggtcatgggagttgggggtatttctggcagtagaatggcctgcgtcgtgactaaactagccctgtgaccttgggcaagttcctgaaatccatgggagcttttgtttcattgtcagtaaactgaagataacaccaacttggcagcgggagtttgtgtcttctgtatgaaatctccctgcctctgtacctggttgagttgctgtcattattttaggggacggtattcagaattcgagcgcaggagctccgcttctccacctgctcccggggagctattgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424671 - DNA, 779 bp, Homo sapiens
catacatacagagagagagagagagagagagagaacacacacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424672 - DNA, 812 bp, Homo sapiens
ggtcccctttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggc

SEQ ID NO: 424673 - DNA, 449 bp, Homo sapiens
agaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgaggtatgtggtagggctgggaggtagcccatctgcatgtcccagctgggaacacagagcctcccagcagggctgtacacaccagaggagggtctgatggtgtggggaggagggacatgcagacaagggtaaggtgggagagtccctgcctggaagggagttttggaaacttctcatcaaccaacctctctcttccttctgcagtcagcacctacacaaatgcctttgccttcactcagttcggagtgctgtgtgccccctggaatggcctgctcatg

SEQ ID NO: 424674 - DNA, 530 bp, Homo sapiens
ccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacac

SEQ ID NO: 424675 - DNA, 461 bp, Homo sapiens
aaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424676 - DNA, 1973 bp, Homo sapiens
aggcgagcaggggactgggaggggctgcgagaggcgcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacaaccacccactagttctcttctccagccaagaggaataaagttttgcttccataaa

SEQ ID NO: 424677 - DNA, 2654 bp, Homo sapiens
aggcgagcaggggactgggaggggctgcgagaggcgcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424678 - DNA, 2724 bp, Homo sapiens
ggtcccctttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424679 - DNA, 2657 bp, Homo sapiens
aggcgagcaggggactgggaggggctgcgagaggcgcgaatgcgaacctggcccgtgcggaaagggcgcggagagccccggcgcggagcaggcgggggacggtattcagaattcgagcgcaggagctccgcttctccacctgctcccggggagctattgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424680 - DNA, 2691 bp, Homo sapiens
aggcgagcaggggactgggaggggctgcgagaggcgcgaatgcgaacctggcccgtgcggaaagggcgcggagagccccggcgcggagcaggcgggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424681 - DNA, 2467 bp, Homo sapiens
aggcgagcaggggactgggaggggctgcgagaggcgcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacagtttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424682 - DNA, 1254 bp, Homo sapiens
gcatcaaaaagccttataggctttggagctgtcccatgaagccaaaggaaaagctgactgtcctcatttcaagtggagccacagccgcccaggattgacgcagccaggaccagtagaaatgggatcacaggattgacgcagccaggaccggtagaaatgggagcaacgcggccttcatcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 424683 - DNA, 3011 bp, Homo sapiens
  misc_feature (779)..(779): n is a, c, g, or t
agcgggggatccaggagcgaggagccgggagcggggaacagggagtcggggagccgggaaccggggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtgggtcgagggaggggcctcggccactgcctcaaggagggccttgctgaacttggtggcccagcccaggccctctctctggcttgtcagtctcatcacagcccctccgccgcaatgtggcctggttctgcgtgtctgctgggctgagtggggctgtggcagaacagctcactcatctgggtagccgggtgggggatatggctggccagggctgccctaccctccctcctcctggtangtggctgtgaggtgcaggcggcctccggggtgccgtgactgcctgcccgctgctacaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424684 - DNA, 2640 bp, Homo sapiens
cgggacagcaactgtcccgcaaggcccggattgaggaggcgggagggaccgaagcaggcggacccaggatttggcgccgcgatctcgaggcttggcctggagccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424685 - DNA, 2672 bp, Homo sapiens
cgggacagcaactgtcccgcaaggcccggattgaggaggcgggagggaccgaagcaggcggacccaggatttggcgccgcgatctcgaggcttggcctggagccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424686 - DNA, 2735 bp, Homo sapiens
agcgggggatccaggagcgaggagccgggagcggggaacagggagtcggggagccgggaaccggggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggctgtacccactcctgacaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424687 - DNA, 2639 bp, Homo sapiens
agcgggggatccaggagcgaggagccgggagcggggaacagggagtcggggagccgggaaccggggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424688 - DNA, 1998 bp, Homo sapiens
ctcagtacgagccggtggttatcggccgagttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424689 - DNA, 1358 bp, Homo sapiens
agcgggggatccaggagcgaggagccgggagcggggaacagggagtcggggagccgggaaccggggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424690 - DNA, 2873 bp, Homo sapiens
agcgggggatccaggagcgaggagccgggagcggggaacagggagtcggggagccgggaaccggggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgaaacaccacagaacaacaaaactccgcacaagggacacagctctcgagccgaagggcgacagcaccacacggacgaagcagagagagagagcaaccccgagcagaggagagacacgagcacagcgcgagagagccgcgacaacaggagccgcatagcag

SEQ ID NO: 424691 - DNA, 877 bp, Homo sapiens
gctgactcttgaggatcccacggtcacgcttcaaacacggaaggatggtgatagctgtttcgcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424692 - DNA, 2567 bp, Homo sapiens
agcgggggatccaggagcgaggagccgggagcggggaacagggagtcggggagccgggaaccggggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatggggtcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgatctgttgagccactttttgtg

SEQ ID NO: 424693 - DNA, 1622 bp, Homo sapiens
agcgggggatccaggagcgaggagccgggagcggggaacagggagtcggggagccgggaaccggggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctctcgccaggtattcaccgtcacgactgtgtaat

SEQ ID NO: 424694 - DNA, 3064 bp, Homo sapiens
  misc_feature (832)..(832): n is a, c, g, or t
cgggacagcaactgtcccgcaaggcccggattgaggaggcgggagggaccgaagcaggcggacccaggatttggcgccgcgatctcgaggcttggcctggagccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggtgtgtgcgggtcaagggtgtacaggccggggggtggtgggagctcccaggagcctttcttctaggattgactcaggctgtacccactcctgacaggccaaggctgttggcatccaggggaacttgtctggggacctgctgcagagcggagggctgctggtggtcagcaaaggtgggtcgagggaggggcctcggccactgcctcaaggagggccttgctgaacttggtggcccagcccaggccctctctctggcttgtcagtctcatcacagcccctccgccgcaatgtggcctggttctgcgtgtctgctgggctgagtggggctgtggcagaacagctcactcatctgggtagccgggtgggggatatggctggccagggctgccctaccctccctcctcctggtangtggctgtgaggtgcaggcggcctccggggtgccgtgactgcctgcccgctgctacaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424695 - DNA, 2715 bp, Homo sapiens
agcgggggatccaggagcgaggagccgggagcggggaacagggagtcggggagccgggaaccggggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424696 - DNA, 2640 bp, Homo sapiens
ggcggggctgggggcaacggggcgcgcccatgacccagccgcccggcaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggctgtacccactcctgacaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttga

SEQ ID NO: 424697 - DNA, 1367 bp, Homo sapiens
cgggacagcaactgtcccgcaaggcccggattgaggaggcgggagggaccgaagcaggcggacccaggatttggcgccgcgatctcgaggcttggcctggagccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggtccaagcacgagatgggctagacttgccaacatgagaggcggctgggcgggaccggaagaactagtcagggtgagcgggcaagacatgcccgaggatcgagaatgatgatcacgaatcccagaacgcaacagcggcgggaatcgccagagggacgacaggcccagacggcctaaacccactcggtgtgaccagcacggcgcagcaggccggagagccacaagccacccaagcaccgcgcgcacaccccacaccaccaaccgacacacacagacacacacccagccaacgagccgagaaggga

SEQ ID NO: 424698 - DNA, 353 bp, Homo sapiens
ccccaggggtctgcagtagtcccttcattagactctcttcattcaaaccctcggaggcagattcagtttccagccaagaccccagtgtaaccagtttttaaaataaagataaaggtgtccctttcctggctaagaatgatgagcaaacacaaaagacctatacctatgaaaaatatgcatgagtaaaacaaacttccactagccttctcttttagcaaacttagtgtatttaatgtcaaacttaatggcaaaaaatgcaaattacagctaatattcctcttttctaacttctactcctggtttgaaatgagggggaaaaaatcatacccactcacactcaccatcaaaaaaaa

SEQ ID NO: 424699 - DNA, 1220 bp, Homo sapiens
  misc_feature (149)..(149): n is a, c, g, or t
aatttttcatatttcaaaacgtttaaataagtaacgggactttttagtttaatatcaaaaatgagggaggaccaaaggaaaaaaaaagccccataaattaagaaaagctgggccaaaaaaaaaaaaaaggccctttagtaatttactantaaataacttttgcttcaaagaaatcaaaattgattaaaaaatattaaggccgggcgcggtggcgcgtgcctgtagtcccaagtagctgggattacaggctcctgccaccatgcccagctaatttttttttttttttttttttttgtatttttagtagagacggagttttaccttgttggccaggctagtctcgaactcgtgacctcaggtgatccgtctgcctcagcatcccaaagtgctgggattacaggcgttagccaccatgcagcccctttcaagccttttaacatcatgtcaccttcacaatgagcagttgctcccattacccagtgaactcaccttctgatgggacagttaccctagttggggcttctcagccttgagagatgtgcagagcagggacctgtccagggcagagcagccagacagcgtggaaataatccaaacagagaaagcattcaagaacttggcctctggttgacttaacacactacttcaagtatatggcaggtctgtataataaactcctgcctgtctagtcttcagcctcatagaaagcaagaaagcaggtggcgtatgttgcagaacaattcttgggtagaacaaggggacatttgatggtttgggtttttcagtaagaaagatgaagtcctggagtatagggtagagtggtacagtggaaaatatttcagcttgggggttagaaaataaacatgccgattcttgctttgccataaatgatgtcacctaacttgtgtgaccctgttttctcatccctaaaatgatttgataagtttaagattaggctatttttaaatgtatggaagaaattgggtgttacccttcttgaaagacattttccctgcaagtatggcaggctgtatctttcagtgtaacaaagttctattaaaggtcataactgctgccctgtaacttttgccttattctagaaacttctactccttgaatgacatgtgttggtacatgtttcttctctttcagatagaatggttaattttgacttgttgcttctgcacacgtgtcctggaaataaaagtttcttcccacta

SEQ ID NO: 424700 - DNA, 1586 bp, Homo sapiens
  misc_feature (149)..(149): n is a, c, g, or t
aatttttcatatttcaaaacgtttaaataagtaacgggactttttagtttaatatcaaaaatgagggaggaccaaaggaaaaaaaaagccccataaattaagaaaagctgggccaaaaaaaaaaaaaaggccctttagtaatttactantaaataacttttgcttcaaagaaatcaaaattgattaaaaaatattaaggccgggcgcggtggcgcgtgcctgtagtcccaagtagctgggattacaggctcctgccaccatgcccagctaatttttttttttttttttttttttgtatttttagtagagacggagttttaccttgttggccaggctagtctcgaactcgtgacctcaggtgatccgtctgcctcagcatcccaaagtgctgggattacaggcgttagccaccatgcagcccctttcaagccttttaacatcatgtcaccttcacaatgagcagttgctcccattacccagtgaactcaccttctgatgggacagttaccctagttggggcttctcagccttgagagatgtgcagagcagggacctgtccagggcagagcagccagacagcgtggaaataatccaaacagagaaagcattcaagaacttggcctctggttgacttaacacactacttcaagtatatggcaggtctgtataataaactcctgcctgtctagtcttcagcctcatagaaagcaagaaagcaggtggcgtatgttgcagaacaattcttgggtagaacaaggggacatttgatggtttgggtttttcagtaagaaagatgaagtcctggagtatagggtagagtggtacagtggaaaatatttcagcttgggggttagaaaataaacatgccgattcttgctttgccataaatgatgtcacctaacttgtgtgaccctgttttctcatccctaaaatgatttgataagtttaagattaggctatttttaaatgtatggaagaaattgggtgttacccttcttgaaagacattttccctgcaagtatggcaggctgtatctttcagtgtaacaaagttctattaaaggtcataactgctgccctgtaacttttgccttattctagaaacttctactccttgaatgacatgtgttggtacatgtttcttctctttcagatagaatggttaattttgacttgttgcttctgcacacgtgtcctggaaataaaagtttcttcccactacttattgctgatttatttcataggaagtcttaaggaaagaggcaaaaaacgggctcatgggtcacttgaagttggaaaattctgtggagattgacaaaggagactcacttttgagcatctgttctcagtgtaaccttcaaatctgtggaaacataactaggcacattttatgattatttagaatgttaataaattgctctgagtttcctcaagtccattttgtaagatcagaccataggtgggtgttgtttcttttaagtgtgtgtactgtgtccaatgttacatttttagaagtgttcatgctttttgtaaagtgattcgttttaagcacattaaaggtcgtttgagtattgtcatgtattttaa

SEQ ID NO: 424701 - DNA, 1070 bp, Homo sapiens
gtttttcaggtaagaaagatgaagtcctggaggtatacggtagagtggtacagggtggaaaatatttcagcttgggggttagaaaataaacatgccgattcttgctttgccataaatgatgtcacctaacttgtgtgaccctgttttctcatccctaaaatgatttgataagtttaagattaggctagtctcgaactcgtgacctcaggtgatccgtctgcctcagcatcccaaagtgctgggattacaggcgttagccaccatgcagcccctttcaagccttttaacatcatgtcaccttcacaatgagcagttgctcccattacccagtgaactcaccttctgatgggacagttaccctagttggggcttctcagccttgagagatgtgcagagcagggacctgtccagggcagagcagccagacagcgtggaaataatccaaacagagaaagcattcaagaacttggcctctggttgacttaacacactacttcaagtatatggcaggtctgtataataaactcctgcctgtctagtcttcagcctcatagaaagcaagaaagcaggtggcgtatgttgcagaacaattcttgggtagaacaaggggacatttgatggtttgggtttttcagtaagaaagatgaagtcctggagtatagggtagagtggtacagtggaaaatatttcagcttgggggttagaaaataaacatgccgattcttgctttgccataaatgatgtcacctaacttgtgtgaccctgttttctcatccctaaaatgatttgataagtttaagattaggctatttttaaatgtatggaagaaattgggtgttacccttcttgaaagacattttccctgcaagtatggcaggctgtatctttcagtgtaacaaagttctattaaaggtcataactgctgccctgtaacttttgccttattctagaaacttctactccttgaatgacatgtgttggtacatgtttcttctctttcagatagaatggttaattttgacttgttgcttctgcacacgtgtcctggaaataaaagtttcttcccacta

SEQ ID NO: 424702 - DNA, 645 bp, Homo sapiens
  misc_feature (149)..(149): n is a, c, g, or t
  misc_feature (613)..(613): n is a, c, g, or t
aatttttcatatttcaaaacgtttaaataagtaacgggactttttagtttaatatcaaaaatgagggaggaccaaaggaaaaaaaaagccccataaattaagaaaagctgggccaaaaaaaaaaaaaaggccctttagtaatttactantaaataacttttgcttcaaagaaatcaaaattgattaaaaaatattaaggccgggcgcggtggcgcgtgcctgtagtcccaagtagctgggattacaggctcctgccaccatgcccagctaatttttttttttttttttttttttgtatttttagtagagacggagttttaccttgttggccaggctagtctcgaactcgtgacctcaggtgatccgtctgcctcagcatcccaaagtgctgggattacaggcgttagccaccatgcagcccctttcaagccttttaacatcatgtcaccttcacaatgagcagttgctcccattacccagtgaactcaccttctgatgggacagttaccctagttggggcttctcagccttgagagatgtgcagagcagggacctgtccagggcagagcagccagacagcgtggccaacaaggtaaaactccgtctcaactanaaatacaaaaaaaatacaaaacacaatttact

SEQ ID NO: 424703 - DNA, 11925 bp, Homo sapiens
  misc_feature (280)..(280): n is a, c, g, or t
  misc_feature (496)..(496): n is a, c, g, or t
  misc_feature (793)..(793): n is a, c, g, or t
  misc_feature (887)..(887): n is a, c, g, or t
  misc_feature (1012)..(1012): n is a, c, g, or t
  misc_feature (1096)..(1096): n is a, c, g, or t
  misc_feature (2408)..(2408): n is a, c, g, or t
  misc_feature (2497)..(2497): n is a, c, g, or t
  misc_feature (2944)..(2944): n is a, c, g, or t
  misc_feature (2973)..(2973): n is a, c, g, or t
  misc_feature (3003)..(3003): n is a, c, g, or t
  misc_feature (9497)..(9497): n is a, c, g, or t
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggnagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatnccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggancagtccacaggcgagagccacgggcccttggacagcctgagggcccccttcaatgagcgcctcgcggagagcaccgcgtcggccgggccccccnccgagcccgccagcaaggaggtcacctgcaacgaatgttcggcctcctttgccagcctccagacctacatggagcaccactgccccagcgcgcgccccccgccacccctgagagaggagagcgcnagcgacaccggtgaggagggggacgaggagagtgacgtggagaacctggccggggagatcgtctaccagccggacggctccgcntacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcaggnccaatgtggcagagggcggcaggaggctggacttcgctgacgaaagtgccaataaagacaatgccacagcaccagaaccaaatgaaagnacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctncagaatggagggggggagcaggtcttcanccacactgccggggcggcggcggcggcggnggctgcggcggcggcggcagccaatatcagtagctcctgcggggccccctcgcccaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccaccgtgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggngatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaa

SEQ ID NO: 424704 - DNA, 11887 bp, Homo sapiens
  misc_feature (280)..(280): n is a, c, g, or t
  misc_feature (496)..(496): n is a, c, g, or t
  misc_feature (793)..(793): n is a, c, g, or t
  misc_feature (887)..(887): n is a, c, g, or t
  misc_feature (1012)..(1012): n is a, c, g, or t
  misc_feature (1096)..(1096): n is a, c, g, or t
  misc_feature (2408)..(2408): n is a, c, g, or t
  misc_feature (2497)..(2497): n is a, c, g, or t
  misc_feature (2944)..(2944): n is a, c, g, or t
  misc_feature (2973)..(2973): n is a, c, g, or t
  misc_feature (3003)..(3003): n is a, c, g, or t
  misc_feature (9497)..(9497): n is a, c, g, or t
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggnagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatnccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggancagtccacaggcgagagccacgggcccttggacagcctgagggcccccttcaatgagcgcctcgcggagagcaccgcgtcggccgggccccccnccgagcccgccagcaaggaggtcacctgcaacgaatgttcggcctcctttgccagcctccagacctacatggagcaccactgccccagcgcgcgccccccgccacccctgagagaggagagcgcnagcgacaccggtgaggagggggacgaggagagtgacgtggagaacctggccggggagatcgtctaccagccggacggctccgcntacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcaggnccaatgtggcagagggcggcaggaggctggacttcgctgacgaaagtgccaataaagacaatgccacagcaccagaaccaaatgaaagnacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctncagaatggagggggggagcaggtcttcanccacactgccggggcggcggcggcggcggnggctgcggcggcggcggcagccaatatcagtagctcctgcggggccccctcgcccaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccaccgtgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggngatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaacca

SEQ ID NO: 424705 - DNA, 3209 bp, Homo sapiens
  misc_feature (167)..(167): n is a, c, g, or t
  misc_feature (170)..(170): n is a, c, g, or t
agtgtgtgaggcagccggggagatctgagtggcggcccgtgagcacgaagagaagaacgcacagaaggcagaaaagtggtgccgacactgaggtggggcccggcgcaccccgggcgatctggccgggaccaacccggaaactggccaggaagtatagctcccggtgnaangcgttgccagggagtggtggtagattaggggtatgaatcaaggatgggattctagcccatgagggcctggtgatatggtcagacctttgctatccataggcagtggtgcttcgggtaggttgtgatgtcttgggaattggtgtcagtatcttgggctattccacttctgacatggcttttctgcttttcctgcggttgtttctcaaccatctacagtcccactggccctcctgtgtatcattcaaacaggggcaggaaaagaagatggtcgtttctcccgcagattccagattcctattcctaggcggttatactgttgagtagacttgttgaagcaggtcagctgggccaaggcatggaagcaattttccctgaatggattgttcttatttcttcccaggcccttcctccacactttcctattcatcatcttctctctaccctccgaaagcatccagtcagctgcagcaacagaggtcagagaggaggaacacctgtagagcctgttttgtttttgttcatgtggccgtgctagctttcttgccttcgttctctcttctcctgttgccgctctcctccagataacttctctggggacctcgtggccatactatttttgtgatgaaggcctttggtgcaaatgggccccagctagaaacagctagctttggggcctctagactaattgcagttgggcagagtgaatggtagctgggagtacttggcaaagaaaatgtgaactagcgggtgtggcacattgggcaggaaggtgttggaagttgtttggctggaaggggaagtatgggagctagccaggactgaatcttcattagaatacaaggttgtccagccctgagcctggtgggatacttctggaagttgtttggctgaaaggggaagtatgggagctgacctaggactgagtcctcattagaatacaaggttgtccagctctgagcctggtgggatacttctggaagttgtttggctgaaaggggaagtatgggagctgacctaggactgagtcctcattagaatacaaggttgtccagccctgagcctggtgggatacttctgttggaaatgttcgttttgagaggatccttcaagccttgacatctcaaactgtgtgccagtgacaccggtaaaacgtcttgagcttcagccctacccctgcccagactgaccggtgatttctgtctccattcctttcagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaa

SEQ ID NO: 424706 - DNA, 4423 bp, Homo sapiens
  misc_feature (280)..(280): n is a, c, g, or t
  misc_feature (496)..(496): n is a, c, g, or t
  misc_feature (793)..(793): n is a, c, g, or t
  misc_feature (887)..(887): n is a, c, g, or t
  misc_feature (1012)..(1012): n is a, c, g, or t
  misc_feature (1096)..(1096): n is a, c, g, or t
  misc_feature (2408)..(2408): n is a, c, g, or t
  misc_feature (2497)..(2497): n is a, c, g, or t
  misc_feature (2944)..(2944): n is a, c, g, or t
  misc_feature (2973)..(2973): n is a, c, g, or t
  misc_feature (3003)..(3003): n is a, c, g, or t
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggnagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatnccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggancagtccacaggcgagagccacgggcccttggacagcctgagggcccccttcaatgagcgcctcgcggagagcaccgcgtcggccgggccccccnccgagcccgccagcaaggaggtcacctgcaacgaatgttcggcctcctttgccagcctccagacctacatggagcaccactgccccagcgcgcgccccccgccacccctgagagaggagagcgcnagcgacaccggtgaggagggggacgaggagagtgacgtggagaacctggccggggagatcgtctaccagccggacggctccgcntacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcaggnccaatgtggcagagggcggcaggaggctggacttcgctgacgaaagtgccaataaagacaatgccacagcaccagaaccaaatgaaagnacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctncagaatggagggggggagcaggtcttcanccacactgccggggcggcggcggcggcggnggctgcggcggcggcggcagccaatatcagtagctcctgcggggccccctcgcccaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccaccgtgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcaggtgaggctggaagggactctgctggtggggaggtgaggtgttttagacattggtagggaacaaacttttgggtgggcgggcttggg

SEQ ID NO: 424707 - DNA, 367 bp, Homo sapiens
ggagaggaaggaggaatatgtcataaatgttcaacggttccatcaagttcaggcagcaccgcgggggttagcccctggatgcctaacagaggttaatgcgagggagggttcaggggttcacgtcgtaactccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaa

SEQ ID NO: 424708 - DNA, 470 bp, Homo sapiens
ggtgttttaagaaaatcctgtgctataaatgaatgttgattttcacccaacacaaaccctctgggagctggcctggtctggctgctgtattgcatcttctactttctcttttagcatcgtccagccaagcagagaaggagctgacagattctcctgcaacctccaaacgcatctccttcccaggtagctcagagtctcccctctcttcgaagcgaccaaaaacagctgaggagatcaaaccggagcaggtgaggctggaagggactctgctggtggggaggtgaggtgttttagacattggtagggaacaaacttttgggtgggcgggcttggggcacacacagttgctcaaagcagtgggtgtgttccccacagatgtaccagtgtccctactgcaagtacagtaatgccgatgtcaaccggctccgggtgcatgccatgacgcagcactcggtgcaacccatgcttcg

SEQ ID NO: 424709 - DNA, 8613 bp, Homo sapiens
  misc_feature (6210)..(6210): n is a, c, g, or t
cgcggcccgagcgcctcttttcgggattaaaagcgccgccagctcccgccgccgccgccgtcgccagcagcgccgctgcagccgccgccgccggagaagcaaccgctgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggngatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcacagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaa

SEQ ID NO: 424710 - DNA, 11860 bp, Homo sapiens
  misc_feature (280)..(280): n is a, c, g, or t
  misc_feature (496)..(496): n is a, c, g, or t
  misc_feature (793)..(793): n is a, c, g, or t
  misc_feature (887)..(887): n is a, c, g, or t
  misc_feature (1012)..(1012): n is a, c, g, or t
  misc_feature (1096)..(1096): n is a, c, g, or t
  misc_feature (2408)..(2408): n is a, c, g, or t
  misc_feature (2497)..(2497): n is a, c, g, or t
  misc_feature (2944)..(2944): n is a, c, g, or t
  misc_feature (2973)..(2973): n is a, c, g, or t
  misc_feature (3003)..(3003): n is a, c, g, or t
  misc_feature (9432)..(9432): n is a, c, g, or t
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggnagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatnccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggancagtccacaggcgagagccacgggcccttggacagcctgagggcccccttcaatgagcgcctcgcggagagcaccgcgtcggccgggccccccnccgagcccgccagcaaggaggtcacctgcaacgaatgttcggcctcctttgccagcctccagacctacatggagcaccactgccccagcgcgcgccccccgccacccctgagagaggagagcgcnagcgacaccggtgaggagggggacgaggagagtgacgtggagaacctggccggggagatcgtctaccagccggacggctccgcntacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcaggnccaatgtggcagagggcggcaggaggctggacttcgctgacgaaagtgccaataaagacaatgccacagcaccagaaccaaatgaaagnacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctncagaatggagggggggagcaggtcttcanccacactgccggggcggcggcggcggcggnggctgcggcggcggcggcagccaatatcagtagctcctgcggggccccctcgcccaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccaccgtgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggngatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaa

SEQ ID NO: 424711 - DNA, 11887 bp, Homo sapiens
  misc_feature (280)..(280): n is a, c, g, or t
  misc_feature (496)..(496): n is a, c, g, or t
  misc_feature (793)..(793): n is a, c, g, or t
  misc_feature (887)..(887): n is a, c, g, or t
  misc_feature (1012)..(1012): n is a, c, g, or t
  misc_feature (1096)..(1096): n is a, c, g, or t
  misc_feature (2408)..(2408): n is a, c, g, or t
  misc_feature (2497)..(2497): n is a, c, g, or t
  misc_feature (2944)..(2944): n is a, c, g, or t
  misc_feature (2973)..(2973): n is a, c, g, or t
  misc_feature (3003)..(3003): n is a, c, g, or t
  misc_feature (9497)..(9497): n is a, c, g, or t
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggnagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatnccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggancagtccacaggcgagagccacgggcccttggacagcctgagggcccccttcaatgagcgcctcgcggagagcaccgcgtcggccgggccccccnccgagcccgccagcaaggaggtcacctgcaacgaatgttcggcctcctttgccagcctccagacctacatggagcaccactgccccagcgcgcgccccccgccacccctgagagaggagagcgcnagcgacaccggtgaggagggggacgaggagagtgacgtggagaacctggccggggagatcgtctaccagccggacggctccgcntacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcaggnccaatgtggcagagggcggcaggaggctggacttcgctgacgaaagtgccaataaagacaatgccacagcaccagaaccaaatgaaagnacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctncagaatggagggggggagcaggtcttcanccacactgccggggcggcggcggcggcggnggctgcggcggcggcggcagccaatatcagtagctcctgcggggccccctcgcccaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccaccgtgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggngatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaa

SEQ ID NO: 424712 - DNA, 743 bp, Homo sapiens
cactcatcagctcccacttccagcgcgtccctccgaccgctgcagccgccaccgccgccgcctcctcctcctcctcctcccggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaa

SEQ ID NO: 424713 - DNA, 2786 bp, Homo sapiens
tcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactccttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattaccccggctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccactta

SEQ ID NO: 424714 - DNA, 1445 bp, Homo sapiens
tcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactccttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccaggtgaggttccgctcaccccgaggccccacggcctgctggtggggtctgacctggggggattggagggaaatgacctgccctccaccaccacccaaagtgtgggattaaagtactgttttctttccacttaaactgatgagtcccctgggtctgtcaaaatgagaaggtcactgctgccacgcttgggaggactcagggctatagcatggccctggggtgggacctgttctcccatcccttgcctcacgtccctgtttttgtttgtttgtttgtttgtgacggagccttggtctgttgcccaggcttgagtacaatggcacagtctcggctcactgc

SEQ ID NO: 424715 - DNA, 2638 bp, Homo sapiens
tcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattaccccggctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccactta

SEQ ID NO: 424716 - DNA, 2207 bp, Homo sapiens
tcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactccttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccaggaggctgagacaggagaattgcttaaacctgggaggcagacgttgcagtgagtcaagatcacgccattgcactccagcctgggtgacgagcgaaactctgtctcaaacaaacaaacaagctctggacgtaggcctgggtttgatttctgactctgctactaattagctgtgtgacttcgggcagatgacatgactgctctgtgcctcagtttccttacttgtaaaatgggatctctacccacttcgctgtagggtttgtaattatctctcgatctatctgtgactttgcacagagtgctagcaaatggcagcccttgggagtggcagcaggggtgctccagtgtcccttgtccctcctgttcctctgtgcttcccagccatcctctcacatgtggttgggaaaagtcttcaaggctcacctgagacctcccctccttcaggaagccttgctagtgccccgcatgacctcctttgcacctgctaatgtctggctcccatactctcgtaggacttaatgcatgccagtggcctccctgcccgcctctttgcccccatcaccaggtggcaggaaactcactcattcattcaataaacttggtccagctgtctgaggctgccagaactggctgtgctgggtcctgggaggcggcaagaaaggtgcccaagggcttacccctgataggagagatatgttggctgaaggatacaatgtggggacaaggacaggaatatatgtgggttccgctctcctctgccgggagagaggggcaggaagggctcagggcagagcccagccttgaaaaatgagtgttgcttggacggacgcttggctaatgcttgtaatcctagcgttttgggaggctgaggcgtatggatcacctgcggtcaggagttaaagaccagcctggccaacatggcgaaaccccatctctactaaaagtacaaaaattagccaggcgtggtggcgggctcctgtaatcccagctactcggtaggctgaggcatgagaatctcttgaagccaggggccagagactgcagtgagccgagatcacaccacttcactccagcctgggtgacagagtgagactccgtctca

SEQ ID NO: 424717 - DNA, 1190 bp, Homo sapiens
tcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactccttcgtgtggtgggactgggcccgctgggagcgagagatagactggatggcgctgaatggcatcaacctggcactggcctggagcggccaggaggccatctggcagcgggtgcgtgcccactgtcccttccccaccctcctctatggcgggagccaccgtaggtgttttcacccgccccccagcatgggcgcagtgtctctctctagaagtgctttcagcgtgcacagtggcttgggcctcctaaaaactgaggcttccggccgggcgcggtggctcacgcctgtcatcccagcacttcgggaggcctaggcgggcggatcaggagttcaggagatcgagaccatcctggccaacattgtgaaaccccgtctctactaaaatacaaagaaatagcaacctgggcaacagagcgagactctgtc

SEQ ID NO: 424718 - DNA, 366 bp, Homo sapiens
cccagcactttgggaggccgagttgggcggatcacctgaggtcaggagttcgagaccagcctggccaacatggtgaaaccctgtctctactaaaaatataaaaattagctgggcatggtggcacgcgcctgtaatcccatctacttaggaggctgagacaggagaattgcttaaacctgggaggcagacgttgcagtgagtcaagatcacgccattgcactccagcctgggtgacgagcgaaactctgtctcaaacaaacaaacaagctctggacgtaggcctgggtttgatttctgactctgctactaattagctgtgtgacttcgggcagatgacatgactgctctgtgcctcagtttccttac

SEQ ID NO: 424719 - DNA, 2992 bp, Homo sapiens
tcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactccttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattaccccggctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccacttaaactgatgagtcccctgggtctgtcaaaatgagaaggtcactgctgccacgcttgggaggactcagggctatagcatggccctggggtgggacctgttctcccatcccttgcctcacgtccctgtttttgtttgtttgtttgtttgtgacggagccttggtctgttgcccaggcttgagtacaatggcacagtctcggctcactgc

SEQ ID NO: 424720 - DNA, 1258 bp, Homo sapiens
tcatcagtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgccccgaagcttccccgcgtccgcccgaggcgcttaccccctcccggagccgctgccacccaaatcgggaggctgagcggggagcgctggccggaaggcccagctgcgccgcctccagcagctgtgtggccttgagccagccactctgcctttcagagcctcggctggcccacctgaaaaacggaaagaagacgcctaccgtgcagtgttattgtgaggatttgcacgatgatgggcatagaatttgtggtgcacaattggtgatgagtgaattttcttgccttcctcccccaccttctctttgaacctgcggactgaggaaggacgcctccatcccccaccctacaggcctgtgttccagcgcctgccacactatggagtgatgtgttcacacagctgtcctcccctgcccatctgttagactgtgggggcagggattccccgttccaggaaaacaccgtgcagaggaggggctctggcagtgtggcatgaaagtggaatatgccacccaaatacccgccaggc

SEQ ID NO: 424721 - DNA, 1206 bp, Homo sapiens
acccttccttctgttcctccagcaccgggtcctggaccagatgcgctccttcggcatgaccccagtgctgcctgcattcgcggggcatgttcccgaggctgtcaccaggaggctgagacaggagaattgcttaaacctgggaggcagacgttgcagtgagtcaagatcacgccattgcactccagcctgggtgacgagcgaaactctgtctcaaacaaacaaacaagctctggacgtaggcctgggtttgatttctgactctgctactaattagctgtgtgacttcgggcagatgacatgactgctctgtgcctcagtttccttacttgtaaaatgggatctctacccacttcgctgtagggtttgtaattatctctcgatctatctgtgactttgcacagagtgctagcaaatggcagcccttgggagtggcagcaggggtgctccagtgtcccttgtccctcctgttcctctgtgcttcccagccatcctctcacatgtggttgggaaaagtcttcaaggctcacctgagacctcccctccttcaggaagccttgctagtgccccgcatgacctcctttgcacctgctaatgtctggctcccatactctcgtaggacttaatgcatgccagtggcctccctgcccgcctctttgcccccatcaccaggtggcaggaaactcactcattcattcaataaacttggtccagctgtctgaggctgccagaactggctgtgctgggtcctgggaggcggcaagaaaggtgcccaagggcttacccctgataggagagatatgttggctgaaggatacaatgtggggacaaggacaggaatatatgtgggttccgctctcctctgccgggagagaggggcaggaagggctcagggcagagcccagccttgaaaaatgagtgttgcttggacggacgcttggctaatgcttgtaatcctagcgttttgggaggctgaggcgtatggatcacctgcggtcaggagttaaagaccagcctggccaacatggcgaaaccccatctctactaaaagtacaaaaattagccaggcgtggtggcgggctcctgtaatcccagctactcggtaggctgaggcatgagaatctcttgaagccaggggccagagactgcagtgagccgagatcacaccacttcactccagcctgggtgacagagtgagactccgtctca

SEQ ID NO: 424722 - DNA, 1501 bp, Homo sapiens
gcggccgcgaattcggcacgagcggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagat

SEQ ID NO: 424723 - DNA, 899 bp, Homo sapiens
  misc_feature (113)..(113): n is a, c, g, or t
acgaaaacactaaaaaaaaaaaaaaaaaaaaaaaaaaaaaaaaaaaaaaaaaaaaaaaaatataaaaaaaaaaaagggcaaaaattctaggttttttttttccatcccagccnaccagtaccatttaatcctattttctcctggacagctcaattcccccagctggagaaagcccccctgttgctgcctgagagagtaagactcgaagttttccttaatcagcctcttttggctgtgcagttagacaactggagcattgaggcaggtgtgccaagggcactctgaccactgccaaggtcaaagccttctgcagaatgaaaactccgacacttccttgctgagaaacaaacaagagagaatggcggggcatttaatcatccacagctgccaatacctaatcaagatgaatggcctggagagacaaggccagggaaagcatcccgtgaagcaggagcgctgagcccaagtctcctgcgagtcaggggagcccctcagccctgggccacattgaggccaagggaataccaggtgggaggccctcagattcaggggaagtgctgagggggtcagaggtcaccatggtcaccaatgagggccttccagctgacacttgccttggccaaagacctttactgagagcctgctctgtcccaggaggcaagataaacgaggcacacccctgccctttgaggacacacagtgaactaatagcaaaagctacatgcatacattatcctgccacctgaagtgtcaacatagacacttgtccctagagatccttaaagcccctctgaaggacaggccactcacagccatgtgtgagacatagaggcataaaggctgtggggaaatgagggcagaagagatgaacttctccatgccccattgttccagactgc

SEQ ID NO: 424724 - DNA, 3659 bp, Homo sapiens
gcggccgcgaattcggcacgagcggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgttttttgttttttccattttatggggaatttaaaaaccattcttgtatcagaaggtgaattaggcgcatggtctttgttttattaataatttccactagagggtgttctcaggtcactttgcagtgaagtggacttagttcctccttgttctgtacaaaatgtctccagactttgtaaaggagctgcccagtttggcctcctgtcccgaaaagaccctaataactaggcagagtgttgtcctgctttcttcgtctcgtaggatgtgctatgattggtgccaggcctcactaacacaggggctacctgtctcttattctcagcacctgtgtcctgagatacgctgcctgagacagagagagtccctcattaacagcctgtgtggctgtcagctttttgcctaaattgtgattcagatgcttttgttctctctcctttcacttattgccacagttgaggaaaagtgtcagattaccctgcagcaagacaagccaaggactgggagggaaaaaaaaaccactctggaggcaactgagaaaatcactgctttggataggaatcagtagggtggctgttttccctttgttgaatctactagagtgacaggaaggactcccagccctttcagtaactatcaggagccctgaaacggtagaggcactgccatccttgtgggatactcaaagcccacagggcttttccctccctattgcatcttctgatgctccccacacctaccctccacctctccacctctgtggtgttcccatttgtgtgtttcccatctgtggagccagactgagcaatagcttagcagcgagtcagggacagctgccactttccacagagccacaggatgggcagagcagggacccagggaatgaatagccagtggacaaacagtcttgagctctgttcagccagagtgatgggccctgccagttaaggggctgtgtcttcatccttgaagacagatgtgcaatattgaccctgcctctccccagggctttgtggaaagatagttgagggctttagtgagatcacactcagagtggggcaattccagcatttatcctggctgcgtttcattgcattgtctgtgaagtataatttctgggccagaattgctcagttgcatttgatccaggactatagattggaaatgggtcatcattgttttctgttgtgattatagccattctagtaggcgtttaaggtcatggcctgcagaaaatgatgtaagaactagttcttaatctttcagatcaagctaatgatgatatggaaccttgagttcgaattgattggtttacttggaaaaaaacatgtttgaaaattgcaaaagttccgccgggcgcggtggctcatgcctgtaatcccagcactttgggaggccgagacgggcggatcacgaggtcaggagatcgagaccatcttggctaacacggtgaaaccccgtttctactaaaaatacaaaaaattagccaggcgtgttggcgggcgcctgtagtcccagctacctgggcggctgaggcaggagcatggcgtgaacccaggaggcggagcttgcagtgagctgagatcatgccactgcactccaacctgggggacacagcaagactccgtctcaaaaaaaaaaaaaagaaaaagaaaattgcaaaagttcctctaaagttaaatcaaaggtggtttgtctagcagagagccagaatcttctaatagtgggcagagcccagagacaaggggaagaaagatgaccttctccccagtccttcccagcaccatttttgtttcacaccaggcttgtggcattttggtgctcacaggggttttgccttctgacctctccttggagtaggccattctcatgcagggctcaccctgaggcaggaggaccaagggctccctgcgtccacggaccacgtatgccttggtggtcactcccatcggggctatcagttctgcactgtgccctggtgcggattttaatgcatatttttatatataaatgttcccaaaggccaaatttgttgccaggttttatacgcaggtcaccataatttgtattatgttccctgagtcaatgaaggttttctttagacttcttaattaaaaagagaagaaagaaaatgttccaaaaaag

SEQ ID NO: 424725 - DNA, 2038 bp, Homo sapiens
gcggccgcgaattcggcacgagcggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggagtcctcatctagccactgaagcagagtgcccacatcaggagcagccagtgctcaagctcccagaaactgcctagtgacctgccttctagacctgcctcctgagaatggggctggccaccttcgaggagagggaagtgagccccttcctgcctcggggtgggcagcatctgtagctgacaattgtatgcatgttcaggacacaggatactcaactcttcgggttcagtgtgctgtgtggagggagaggaagttgacacacgtgaaccatagaataaacaacgaccacagaacatcaaggtagagatggggctgctgggtatcaggaaggcttccaggaagaggtgacaatgagcggcgatcaaggtttctaggaagaggtggccataagaggtgactgttccatggaaaccgaggtgctgatggacagctcaattcccccagctggagaaagcccccctgttgctgcctgagagagtaagactcgaagttttccttaatcagcctcttttggctgtgcagttagacaactggagcattgaggcaggtgtgccaagggcactctgaccactgccaaggtcaaagccttctgcagaatgaaaactccgacacttccttgctgagaaacaaacaagagagaatggcggggcatttaatcatccacagctgccaatacctaatcaagatgaatggcctggagagacaaggccagggaaagcatcccgtgaagcaggagcgctgagcccaagtctcctgcgagtcaggggagcccctcagccctgggccacattgaggccaagggaataccaggtgggaggccctcagattcaggggaagtgctgagggggtcagaggtcaccatggtcaccaatgagggccttccagctgacacttgccttggccaaagacctttactgagagcctgctctgtcccaggaggcaagataaacgaggcacacccctgccctttgaggacacacagtgaactaatagcaaaagctacatgcatacattatcctgccacctgaagtgtcaacatagacacttgtccctagagatccttaaagcccctctgaaggacaggccactcacagccatgtgtgagacatagaggcataaaggctgtggggaaatgagggcagaagagatgaacttctccatgccccattgttccagactgc

SEQ ID NO: 424726 - DNA, 2127 bp, Homo sapiens
gcggccgcgaattcggcacgagcggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccagtcctcatctagccactgaagcagagtgcccacatcaggagcagccagtgctcaagctcccagaaactgcctagtgacctgccttctagacctgcctcctgagaatggggctggccaccttcgaggagagggaagtgagccccttcctgcctcggggtgggcagcatctgtagctgacaattgtatgcatgttcaggacacaggatactcaactcttcgggttcagtgtgctgtgtggagggagaggaagttgacacacgtgaaccatagaataaacaacgaccacagaacatcaaggtagagatggggctgctgggtatcaggaaggcttccaggaagaggtgacaatgagcggcgatcaaggtttctaggaagaggtggccataagaggtgactgttccatggaaaccgaggtgctgatggacagctcaattcccccagctggagaaagcccccctgttgctgcctgagagagtaagactcgaagttttccttaatcagcctcttttggctgtgcagttagacaactggagcattgaggcaggtgtgccaagggcactctgaccactgccaaggtcaaagccttctgcagaatgaaaactccgacacttccttgctgagaaacaaacaagagagaatggcggggcatttaatcatccacagctgccaatacctaatcaagatgaatggcctggagagacaaggccagggaaagcatcccgtgaagcaggagcgctgagcccaagtctcctgcgagtcaggggagcccctcagccctgggccacattgaggccaagggaataccaggtgggaggccctcagattcaggggaagtgctgagggggtcagaggtcaccatggtcaccaatgagggccttccagctgacacttgccttggccaaagacctttactgagagcctgctctgtcccaggaggcaagataaacgaggcacacccctgccctttgaggacacacagtgaactaatagcaaaagctacatgcatacattatcctgccacctgaagtgtcaacatagacacttgtccctagagatccttaaagcccctctgaaggacaggccactcacagccatgtgtgagacatagaggcataaaggctgtggggaaatgagggcagaagagatgaacttctccatgccccattgttccagactgc

SEQ ID NO: 424727 - DNA, 2386 bp, Homo sapiens
gcggccgcgaattcggcacgagcggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggctggagtgcaatggtgcaatctcagctcgctgcaacctctgcctccagggttcaagcgattctcctgcctcagcctcctgagtagctgggattaacagcccatctcagcactagcacagtgcatggtgcaacagagcaggcagtcagtaactggttgttgaatgactgagttacatgggaagggctgggccctccagggctgactgacaggtgtgagagtttggaccactgcatcacatcagctgtcagtaaggacagtcctcatctagccactgaagcagagtgcccacatcaggagcagccagtgctcaagctcccagaaactgcctagtgacctgccttctagacctgcctcctgagaatggggctggccaccttcgaggagagggaagtgagccccttcctgcctcggggtgggcagcatctgtagctgacaattgtatgcatgttcaggacacaggatactcaactcttcgggttcagtgtgctgtgtggagggagaggaagttgacacacgtgaaccatagaataaacaacgaccacagaacatcaaggtagagatggggctgctgggtatcaggaaggcttccaggaagaggtgacaatgagcggcgatcaaggtttctaggaagaggtggccataagaggtgactgttccatggaaaccgaggtgctgatggacagctcaattcccccagctggagaaagcccccctgttgctgcctgagagagtaagactcgaagttttccttaatcagcctcttttggctgtgcagttagacaactggagcattgaggcaggtgtgccaagggcactctgaccactgccaaggtcaaagccttctgcagaatgaaaactccgacacttccttgctgagaaacaaacaagagagaatggcggggcatttaatcatccacagctgccaatacctaatcaagatgaatggcctggagagacaaggccagggaaagcatcccgtgaagcaggagcgctgagcccaagtctcctgcgagtcaggggagcccctcagccctgggccacattgaggccaagggaataccaggtgggaggccctcagattcaggggaagtgctgagggggtcagaggtcaccatggtcaccaatgagggccttccagctgacacttgccttggccaaagacctttactgagagcctgctctgtcccaggaggcaagataaacgaggcacacccctgccctttgaggacacacagtgaactaatagcaaaagctacatgcatacattatcctgccacctgaagtgtcaacatagacacttgtccctagagatccttaaagcccctctgaaggacaggccactcacagccatgtgtgagacatagaggcataaaggctgtggggaaatgagggcagaagagatgaacttctccatgccccattgttccagactgc

SEQ ID NO: 424728 - DNA, 7446 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424729 - DNA, 7839 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcct

SEQ ID NO: 424730 - DNA, 8220 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcct

SEQ ID NO: 424731 - DNA, 7479 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424732 - DNA, 7590 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424733 - DNA, 7548 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424734 - DNA, 7515 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424735 - DNA, 7494 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424736 - DNA, 7659 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424737 - DNA, 7602 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcct

SEQ ID NO: 424738 - DNA, 7425 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424739 - DNA, 5243 bp, Homo sapiens
  misc_feature (5158)..(5158): n is a, c, g, or t
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcantgacctggagcagctgacttaccagggcctcagtttcattaactggtgaatggagtcataatagaatctcctcggaggtcacaat

SEQ ID NO: 424740 - DNA, 7614 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424741 - DNA, 8118 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcct

SEQ ID NO: 424742 - DNA, 7692 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagta

SEQ ID NO: 424743 - DNA, 5317 bp, Homo sapiens
  misc_feature (4850)..(4850): n is a, c, g, or t
  misc_feature (4861)..(4861): n is a, c, g, or t
  misc_feature (4870)..(4872): n is a, c, g, or t
  misc_feature (4893)..(4894): n is a, c, g, or t
  misc_feature (4901)..(4901): n is a, c, g, or t
  misc_feature (4943)..(4943): n is a, c, g, or t
  misc_feature (4973)..(4973): n is a, c, g, or t
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcaggtagggctgaggtgggcaggatccatctgtgggcncaggtcactcngcatgggcnnnttccaggacagaaagagcaanncagggtncaaaatgccatgaaagaagcatcatattttacagcagaggcngttgctggtacctgtgggccaaatctgggnatgttttattggtctacaacatgtttaacatgttttgaattagtgatgaatatttttaaactggtgaatttgggctgtgtgcagtggctcacacctgtaatgccagtgcattgggaggcctaggcaagaggatcacttgaggccaggagttggagaccagcctgggcatcatagcaagacccccagctctacaaaaaataaaaacaattagccgggtgtggtggtatcatctggagtcccagctgaggtgggaggatctcttgagcccaggagtttgaggctgcaataagctgtgatcgcaccactgcactccagcctaagcaatagaacaagaccctgtctct

SEQ ID NO: 424744 - DNA, 1300 bp, Homo sapiens
caaggtcttcagccacaagttatacctaaaaaaacatgagagaattcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagataattcattcatgagagagttcttacaaactgagtatggcaaactcttcatgctaagttctagcattaatcaacatcagagattccatactaaagagaaatcatagcaatgtatgtgaatcaggtctcttgaggcctgccaaatgactagatatcaaaacatacatcttggatgaaaccatacagatggattatgtatgctgaggctattattcaaggaccattactatggaacatgataagatttacacaagcgataattcagtctctagttctccaatatttatgatactgcatgctgcagaaaagtcacagctccaaatacgttgaatctcatgacgcgatgcatgtcgaaggtccaagggcatgtggaaatggtcagttatattcaggcaattaaaaaacctaattatatggggttttttgaaaaggctactttacattttatgactttcatcctcaactctgaaatcacttcatgtgacttctttacagacctttcactgtggtctcttgaatcagtaggatgctgggcgcggtggctcccgcctgtcctcccaaagggctgggattacaggtgtgagccaccatgcctggcctaaatcctgttagttttgaatggaaattttctttctttcttttttttttttctgggacagattcttgcttcgagacaatgacaaatacaaactaggtttactgtaaatatgagaaagggaaaaaatacttttattgtattagaagacttgaaatcacatgaagtgataccaatcttttgttgttgttggtcagatgttttagctattttaggtgtttgggttttttgtctttctacataactgctaaccttgttagtatctgcagaatgccttaattaggaaaggtattaaccctatgtgtcagatttgtataattcatattgctttacatggagtcttccaataaatgtatatggtatatgtctctatttgctgtctttgatttcttttatcagcatttggtagttgtaacataacagttctatgaatgttttgtttcacatgtatttctttgccccccccctttttttttttttttttttgagacggagtc

SEQ ID NO: 424745 - DNA, 4458 bp, Homo sapiens
ctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgtt

SEQ ID NO: 424746 - DNA, 1944 bp, Homo sapiens
  misc_feature (308)..(308): n is a, c, g, or t
  misc_feature (686)..(686): n is a, c, g, or t
  misc_feature (1333)..(1333): n is a, c, g, or t
aaatttccttttgatgaagtcattgactaaagcgtcattaaaacaaaacaaaaaaagaattccaaaaaccctccaaaattcctttttaaagataggaaggcatacctgctgtcattttataggtagaacactaaaacacagtaaattacctggcctccaacttggtagtctgatttttttctgccttggtctggtgtttttgtggttttgttcttactttttgtgagttgtgaggggttttttgttgtttattttttgttaggtgtatagacacacttttggatgtcatatttaacagggaaagcatngagtcatgggcctgaataacagttgagtacaaatatttataaattggttgaagtaactttgatttcaatgttatattttaaagtctaggttattttactacagagcattacaatgataaaatatttcctttttttttttttttagcttgtcagctcatttgcagcttacgtttactggtttcttccacaaaaatggtatgtatttaaaagtaaataaagtggcattttaatagcaagatacctttgtgaatgtaaaaaaagtggggcttctgagtgtaaatttataaaattaagtttaatggaaaatatgttggttctgatgtttttgaactttaaggtatgaaggctaatgatgaaatttgtttttggtggatgggngtgcagagtgaaggctggagtgcaatgttatgatcttggctgactgcagcctccacctcccgggttcaagcgattctcctgcctcagcctcctgagtagctgggattacaggcacgtgccccatgcctggctaattttttgtatttttagtagagacagggtctcaccatgctggccaggctggtcttgaactcctgacctcgtgatccacccgccttggcctcccaagggggcgtgagccaccacgcctggctaatgatgaagattttaacaaattgtcttagaacttcaataggtaaagaatctcctcagtagaaccttttatgcataaacattttgaattaatgatactgtatcatgttttaaaaaaacacagtaaaacaactgaaataaccactattaccaatggcatatattaatattttagatattattcaaaggaaattatatggtatattactccagtaaaagctcaaagcatgctggaaagaattagagttgttttaaaaatggaaaaatacggccaggcgcagtggctcacgcctgtaatcccaacattttgggaggctgaggcgggtgtatcatgaggtcaggagttcaggatgttcaggagttcaggagttcagctggccaatatgatgaaaccncatctctactaaaaatataaacattagccaggcgtggtggtgggtgcctgtagtcccagttacttgggagacttaggcagaagaatcacttgaacctgagagtcggaggttgcaatgagctgagattgcgttactgcactccagcctgggcgacagagcgagactccatctcaaaaaaaaaaaaaagggaaaatcacttatcagcttatccatcataagtctgtgtatatggcatatctttttattatgcaatggaataaaaccattattagaaacatgccaggttggttgtcttggtatcgtttagtaagaaacaaagattgaaaatgagtcctggtgggccgggcacggtggctcacgcctgtaatcccagcactttgggaggctgaggcgggtggatcacaaggtcaggagatcgagactatcctggctaacatggtgaaaccccgtctctactaaaatacaaaaaaactagctgggtgtcgtggtgcacacctgtagtgtcaccagtggcactccagcctggtgacagagcgagactctgtctaaaaaaaaagaaaaagaaaatgagtcctggcctggtggctcatgtctgtaatctcagcattttg

SEQ ID NO: 424747 - DNA, 226 bp, Homo sapiens
  misc_feature (8)..(8): n is a, c, g, or t
cgatgagnatgtggacaacaaagtagagaggatttggggtgattgtacagtcaggaagaagtactctcatgtggacctgatgggagcaagatcttcgtctccatcaggaaaacaagcctggttcagttaaacctactcaaactattgctgttaaagaatcattgactacagatctacaaacaagaaaagagcaacatgggagactattctgatgggagcaagatcg

SEQ ID NO: 424748 - DNA, 4405 bp, Homo sapiens
ctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaaggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgtt

SEQ ID NO: 424749 - DNA, 4290 bp, Homo sapiens
ctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatatttgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgtt

SEQ ID NO: 424750 - DNA, 2097 bp, Homo sapiens
ctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacagtaattattattatctttattggcaattatcttggaatattattttgttttgaaaattgcttactatgaactagacttttattgtaaaggaactttttttaaaaaaaaa

SEQ ID NO: 424751 - DNA, 401 bp, Homo sapiens
ctaaatcatttaatgtaaagtagcaaatgtcttgtagactgaattttttttacatctactgtaccattcaaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgtt

SEQ ID NO: 424752 - DNA, 351 bp, Homo sapiens
catttgacagtgtctgccttggcctcccaaaatgctgggattaacaggcgtgagtgacctcgcgtcactgggcatatttaattaaagagaatatctctaatttgattttccgcttaaattttttaaactatttttagaagtgatatttaaacaaaatatcttgttatgcgtaaattggagatttgcttttttttttttaattgtttttagtttctctataacaacaatacaaggcaacaaactgaagcaagagatgacctgcattgcccttggtgtactctgaactgccgcaaactttatagtttactcaagcatcttaaactctgccatagcagatttatcttcaactat

SEQ ID NO: 424753 - DNA, 3473 bp, Homo sapiens
acagcagcgaggagagagagtatgatgatatgagaacatgaaatatgatgtcatgagagctcagcagaagaaacgaatcgtgaggatgggaaagacattgtgccaatgacagtattgataaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctgtt

SEQ ID NO: 424754 - DNA, 3984 bp, Homo sapiens
ctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaaggggagaagttgagttgccagccaccatcagaagctacgattctcctaatagcggttaaggtagggatacataagcgttggaaagcagtgttcgagacatttattagatgaattatcacgacttgataggtatttaagacgtgtgtagagtagaggctatatgtcgtatgagtgaggatggtgatatgtcatcgagtataaagtatatagtcatggatttttatgtgtaccaaagaatagggaagagggagacatcaggtatgatgacagagtattgaatggtaagctctgatagtatgatgagttctaggttatgtta

SEQ ID NO: 424755 - DNA, 450 bp, Homo sapiens
  misc_feature (72)..(72): n is a, c, g, or t
gatgctggagagcatgatcaagaagccccgccccactcgggctgaaggcagtgatgtggccaaagcagggcntactggacttctggggggcagtgtgtgggcccgtcaggcagctgaggcctccagctcccagcacaggccccctcagagcagtggggcagccgatggcctatgctagataggccacagcccctgccttagctagggattgagaagaaacagacacataagatgcaatgtggtgtgtttaggttgtgttgagtttgagatactgatgggtcgttgaagtgggtctgcttagtgggcaattggatacacaagaccagaggtaagaggagaagtcctgggctggaagcaggagtggagtgggggctgaggcatagaagggatgaggtggtgtcgcataggaagagaacttgggatggattgagaagctccatatgagaaggc

SEQ ID NO: 424756 - DNA, 380 bp, Homo sapiens
  misc_feature (353)..(354): n is a, c, g, or t
  misc_feature (357)..(357): n is a, c, g, or t
ctcaggagattggcctccctccttgaggctccctccttgagttccaccctcatttggggtggaacttggtctttggggccctggcctgttttccccagcctccctcactctgtgtcttccacaggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccgagcannagntgggatgagagcaagatgggtcg

SEQ ID NO: 424757 - DNA, 314 bp, Homo sapiens
tgagtcggaggctggatgacccaggggttaacttggctccaggtctctcgttctagagggacagagggcagaaagactcctcaaatgccctgtcccctctccctcagcctttcatctttgtccttcctcttggcctctcctcgtcacctgctccctgcttgagctgttgcttcccaagttacactttctgtttcctacgtgttgggcccactctcttcttcatgggtcctttagactgtagaacacatgctcttctcatcttcagaaaacatgccctggtttctttaggccagtgtcctgccaactcctttgcc

SEQ ID NO: 424758 - DNA, 5728 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttcctttgacttgtatgctctttcgggggctcaggaaagcctgttgcatgggacatgctcactagaaacagtcgccagatgattattctgcagtagaagcaggtaggaaatttctggaaatttctcaggttaagcagcaagagctgtaacccctcctctgggctaacaggagttgtgggtccactctctcctgcccaccctctgagggtgtgtctgagcagagtacatcctgcctgggttctttgtggccagccagttttggtggtgagctggaaacaaccagagcccctttccagttccacagaaacctctcctttcaaaaatgttgcattcagttcgttaacactgccaggtgccattctgattgcctctaggacttggcagctgaaatctctgggccctttcaacacagttgaaaggcccttctcttcctgaagctctgtttccatagttggctgtgctgggatggaacaaaaatgacgccacacaaaaaatttaagatagatccggttccgtggatgacatgaactgatgatagccagtatcaaacaaacagcgatagtgaaa

SEQ ID NO: 424759 - DNA, 5187 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttt

SEQ ID NO: 424760 - DNA, 4315 bp, Homo sapiens
gatccctacctctgaaagaacatccaggagtttttgctcagctctctccgagacccttagcagagatcctgttgccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttt

SEQ ID NO: 424761 - DNA, 5112 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttt

SEQ ID NO: 424762 - DNA, 5007 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttcctttgacttgtatgctctttcgggggctcaggaaagcctgttgcatgggacatgctcactagaaacagtcgccagatgattattctgcagtagaagcaggtaggaaatttctggaaatttctcaggttaagcagcaagagctgtaacccctcctctgggctaacaggagttgtgggtccactctctcctgcccaccctctgagggtgtgtctgagcagagtacatcctgcctgggttctttgtggccagccagttttggtggtgagctggaaacaaccagagcccctttccagttccacagaaacctctcctttcaaaaatgttgcattcagttcgttaacactgccaggtgccattctgattgcctctaggacttggcagctgaaatctctgggccctttcaacacagttgaaaggcccttctcttcctgaagctctgtttccatagttggctgtgctgggatggaacaaaaatgacgccacacaaaaaatttaagatagatccggttccgtggatgacatgaactgatgatagccagtatcaaacaaacagcgatagtgaaa

SEQ ID NO: 424763 - DNA, 3273 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccagggtgagattctgctggaaccttctggggggcagtgtgtgggcccgtcaggcagctgaggcctccagctcccagcacaggccccctcagagcagtggggcagccgatggcctatgctagataggccacagcccctgccttagctagggattgagaagaaacagacacataagatgcaatgtggtgtgtttaggttgtgttgagtttgagatactgatgggtcgttgaagtgggtctgcttagtgggcaattggatacacaagaccagaggtaagaggagaagtcctgggctggaagcaggagtggagtgggggctgaggcatagaagggatgaggtggtgtcgcataggaagagaacttgggatggattgagaagctccatatgagaaggc

SEQ ID NO: 424764 - DNA, 2620 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctgtcgtaggagtacaaggtttttattttttttaacagtgattaaaatatttattggtcattta

SEQ ID NO: 424765 - DNA, 2209 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgacgaagggggatggacacacgaagggggatggacacacgaagggggatggacac

SEQ ID NO: 424766 - DNA, 261 bp, Homo sapiens
ctgcgctatcccatcaacgaggaggcactggagaagattggcacagctgtgagggggctgtggtagacggggcatggcaggggaggcaggagagacccagaatcttaccagtctctggatgtgtgtaacagcaagacctggtgtgttgtagaagttcgtgggagggcccctgactccagctgggagccacagtgtgggtaccaggagggtgtctgcaggaggggacatctgagcagcatctttaaggatggggacaggcac

SEQ ID NO: 424767 - DNA, 433 bp, Homo sapiens
gcctgcccgcttgaccatggtgatgttgctccccagtggactgctgggacggcccggatgggatgccagttatttaccatgggcacacccttaccaccaagatcaagttctcagatgtcctgcacaccatcaaggagcatgcctttgtggcctcagagtgagtcggaggctggatgacccaggggttaacttggctccaggtctctcgttctagagggacagagggcagaaagactcctcaaatgccctgtcccctctccctcagcctttcatctttgtccttcctcttggcctctcctcgtcacctgctccctgcttgagctgttgcttcccaagttacactttctgtttcctacgtgttgggcccactctcttcttcatgggtcctttagactgtagaacacatgctcttctcatcttcagaaaacatgcc

SEQ ID NO: 424768 - DNA, 557 bp, Homo sapiens
gatatcccctcacacacatatgcagtagccatgctgaccattggtgggctttgcttcccacagcacttggacgagaacagccccctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctttgtcactgtcagctttgacccctgcatgtttacctatgccaggcactggggaacccgtcagaatcagcagaacaaagttgatgctgctggttggctgacatccccaggcctaatgggttgtaccacagggatgtgacagaggcttggagatggggtggagagggagacacggcctgaggaagaagcatgagtcagagctgagttggaacactggctccaccacaaccagcagtgacttgtttgagttgtagcgtcgtc

SEQ ID NO: 424769 - DNA, 5161 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttt

SEQ ID NO: 424770 - DNA, 5035 bp, Homo sapiens
  misc_feature (4882)..(4882): n is a, c, g, or t
  misc_feature (4886)..(4886): n is a, c, g, or t
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtattggcaagcttgccagtgtacctgctggtgggctgtagccgtctctgctgccccagcntctnagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaa

SEQ ID NO: 424771 - DNA, 5397 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgaggtttggtttggagtggggaggtggggttttccctgggcccccttcatctctccactgggcgattcttgatccaggtgggaggcagtgggagtagggaaccatgctggaccattctgggaagctgtgctggctgggagttgggttctgccttccgtggggcaccttgttgtctgttgaccatactagctagcttaccttctctccctgcagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttt

SEQ ID NO: 424772 - DNA, 2916 bp, Homo sapiens
cccacgcgtccgctcatcagctactatgagaaacacccgctataccgcaaggaattgggaaaaaaaggggcccctttttaggggctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttt

SEQ ID NO: 424773 - DNA, 1176 bp, Homo sapiens
gtgtcatccccgtatcttcaggtgggcatgtcccagccatgggcaatgtgccttgtgctgtgtctcctcctcaggcaggcagaacccttctccatgcaggcctacattcctctgccctggtccaggccaaactgcaggggatctagcttctcaccctgcccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtccttt

SEQ ID NO: 424774 - DNA, 3077 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcaccaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccagggacttggcagctgaaatctctgggccctttcaacacagttgaaaggcccttctcttcctgaagctctgtttccatagttggctgtgctgggatggaacaaaaatgacgccacacaaaaaatttaagatagatccggttccgtggatgacatgaactgatgatagccagtatcaaacaaacagcgatagtgaaa

SEQ ID NO: 424775 - DNA, 1909 bp, Homo sapiens
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcgtatgttcagtc

SEQ ID NO: 424776 - DNA, 1096 bp, Homo sapiens
  misc_feature (27)..(27): n is a, c, g, or t
aaacaattcgggccactgaggatgccntccttcttggctcttggtcccaagcgaataccgcccggggcgtttattataaccgtaccggagtactatacgtctaagtacagctggtgcaatcgacaggcgcggtgtacgcgaccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagtgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424777 - DNA, 1430 bp, Homo sapiens
tgggaggctgaggtgggtggatcacgaggtcaggagatcgagaccatcctaacacggtgaaaccccgtctctactaaaaatacaaaaaattcaccgggcgtggtggcgggcgcctgtagtctcagctactttgggagtctgaggcagaatggcttgaacccgggaggtggagcttgcagtgagccgagatcgcgccactgcactccagcctgggcgacagagcaagactccgtctcaacaacaacaacaaaaaaaagagcctccttcagattggtgccagtgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataactggcaccagcctgaaccagcctttggaggccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424778 - DNA, 1109 bp, Homo sapiens
tgggaggctgaggtgggtggatcacgaggtcaggagatcgagaccatcctaacacggtgaaaccccgtctctactaaaaatacaaaaaattcaccgggcgtggtggcgggcgcctgtagtctcagctactttgggagtctgaggcagaatggcttgaacccgggaggtggagcttgcagtgagccgagatcgcgccactgcactccagcctgggcgacagagcaagactccgtctcaacaacaacaacaaaaaaaagagcctccttcagattggtgccagtgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataacttgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424779 - DNA, 3141 bp, Homo sapiens
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424780 - DNA, 2738 bp, Homo sapiens
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtgtgtgtgtgtgtgtgtgtgtgtgtgtgtgtgtgtgtctctctctctctctctcgcggggggtgtgtgggtcgcgcgcgcgcgtgcggtgggggggctctttgctgagaggagtcgtcacatatacgagacgtgtggcttgcagaatagactgtagtagtgttttagtgcagtggtgacggcagaagaagcagcataccatattattagtgtagt

SEQ ID NO: 424781 - DNA, 2847 bp, Homo sapiens
acaactacggctaggtacgaggctggcgggtgtggcgcggggctggtagcggccggagccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424782 - DNA, 2852 bp, Homo sapiens
actgttgatgtcatctatgatgtcatgagggtggtggccatcaacattacagcccatagactgggcagtccccggaatctctttaatggttccagagagttctctggctaaggatcggtgccgcatctgtcgagcaatgttgacgatctcatcaaaagtgatattcccattgtgtttaatgtttttctgtttctttctgtctcttggtggtttcttgagggctttgatgatcggggcagaggcagaaggcaccacctcaatctgggcctgtctgttctcaatggtcagtttcactgtaatcctcaggcccttccagtcacccgttgccttggcaatgtcatcaccaaccttttttggagacagacccagggggccgatcttgggggccagggcagaagtggcaccgacttcacctctggtgcacctcagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424783 - DNA, 1289 bp, Homo sapiens
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagtgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424784 - DNA, 246 bp, Homo sapiens
ggtcaagggggcgagtgtgagattcgccgtgcagggccagggagtgaggagctcactgtcaccaatgctcgatatgtccctgtctcctgtgagaaagaagtgaggacccatgggcactggaactgggaaatggggaggagtgggcagggtgccacgagatggaggtagagggagaaaggagcaagagagaattgaaggatgaagtgcaagttatcaggctgggttaccacatccggttttggcctg

SEQ ID NO: 424785 - DNA, 3123 bp, Homo sapiens
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424786 - DNA, 2642 bp, Homo sapiens
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgcgattaccacccgtcagccttgtcaggacccgtgggtggttgtaggcttctccattccaatcccttttgtcttctagggcagggagcacatttgtgcagaaaggttttgcaggtatctgaggcactgctcacctggttccatttttaattattagcttttgagttaagttttttaaaaaacgggtgattaatttaacctgagaaagctgatt

SEQ ID NO: 424787 - DNA, 955 bp, Homo sapiens
acaactacggctaggtacgaggctggcgggtgtggcgcggggctggtagcggccggagccgtgcgagttctctaccctgcttcgcgagcgggcgagagaacgcgagtcccaggatccccggcacccacttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagcaggcagaagcaggaagcaagggtcttggtgaggggcagaagcaggaagcagaaaagttacca

SEQ ID NO: 424788 - DNA, 2581 bp, Homo sapiens
agggtctcttttcccaacagaggtcccccctattggaagtaaaggggaacatagaactgaagagacctctgattaaggccccttcccagctgcctctctcaggaagcagactcaagaggaggcctgaccagatggaagatggcctggagcctgagaagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcacc

SEQ ID NO: 424789 - DNA, 546 bp, Homo sapiens
aagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggaggtaagggccagattttcaccagatgtcagccccgctttcctggcagaggtcatgcctcccctcccttccaggtacccctcaagtctgggctgagaactcctgagcacctatctttagcagtataggtgctgctgaagatacctctctcttgacctgtctgcaccccagcccactcctgactgtcttgctttctgccacgcttcttcctacccttgactgtttgcaaagctctcatttagatctgtgtctttcttagtcctccatccctctttct

SEQ ID NO: 424790 - DNA, 1586 bp, Homo sapiens
ttttttttttttggtaaggattttttccccctttataagtttttgtttccatatgggaggaggggagggagcctctgggtcacccagaatgaggggccttcccaaaacacaacaccccacctctctgctttcagttctagatctgagggaagccatgggagtagaggtagcagaggcgtctgagctgaaatggggcatttggagcaaggaccccagagttcccagatcttctcagctactctcctcccactggagctgtccctcctaggtgggaatgttcactcttttgttgtcaggttgtatgggggggcagggacagtgctgctgggaaggatgccagctctgggattgggccagtcctgtgggcaagacttgcaagaggctggatcaacttggtgtggtatctctgatggcttagagtaatggcaatgagggtctctgttgtgatgtcactgagtactttctggggtgcttctgggcaccccttatgatgtcacaggaagcagttcctcagaggttacttcctgtgaacataagggagcaggtacttcctgtgatgtctcaatgagttcttccttgaaggtcactttggtgatatcatgggaaggtgtacttccggtgatgcctagaggtcacgtcctgtgatgtcattaggctgaagcatgtacttcctgtattggacagtgaccagtctctgacctgccttctccctccacacccttctttggtgggtgttggcctgggggtcttcctaggaagagaataaggcacgggacttggatccaatctggaggactctaacggaaaaaaaccaatattgtcagggtcatctccattcaaacacgtcaagtctgcgaactcgccctggagggaggggtgggagatggacctagtgcaaactactgttaaagacctcccttcccacccctgccttttgtgtgcatgcctgtgtctgcgtggctttgtttcattgaatcgggtgagccaagtgtgtggtggctctgtcaggccagtatggccaggtgtagagttcagtgagccatagtagggtcccttgggccagaatgcttcgtgtggtctgataggttagattggtttggtggcttccagcaagctggcatacttcggtgatgtctgatggatcagaatgttttggtgtgctcaccaggggctctggagaactagaatgttctgatggagtctgacaagccaggcggccttgagagttggtttaggagtggctccctgagtgctgtggctgtggtcagctctaaggacctgttggcagactgagatttcagggcctgacaaccatgtagactaggatagctgagacctccctctacccccacccatctccctctcttccttggagaccacctccactttctccaacccaaagcagggcgcccagtgccctggttccatcatcagcatctctgggggaggggcgccccatgcccaccctctcccccatttgtccgcctcctaggtcttccaaacccttttcttctctatgactttgggggaaatccagcctccttgtctctctcctaaaaaaggagggaagaaaagccacagagaca

SEQ ID NO: 424791 - DNA, 725 bp, Homo sapiens
cctggtggcgaattcggcacgaggcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggc

SEQ ID NO: 424792 - DNA, 3514 bp, Homo sapiens
cggccgctcgcgatctagaactagtcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagctgggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaataaaaaatgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttttagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaagtggaggtgtttacaccagcaaaatactcattttttaagtgtaattaagttgaagatcaaaaaatggaaatgtataattaaatcatacttagcaaatctaacacatgaaatgtaacatctgcatatggagaaccgtgttactttattgaaaaacattaaaagtttgagaactt

SEQ ID NO: 424793 - DNA, 775 bp, Homo sapiens
ggcgggactaactagcaaacggggactagaaatagggatgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggc

SEQ ID NO: 424794 - DNA, 3563 bp, Homo sapiens
ggcgggactaactagcaaacggggactagaaatagggatgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagctgggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaataaaaaatgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttttagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaagtggaggtgtttacaccagcaaaatactcattttttaagtgtaattaagttgaagatcaaaaaatggaaatgtataattaaatcatacttagcaaatctaacacatgaaatgtaacatctgcatatggagaaccgtgttactttattgaaaaacattaaaagtttgagaactt

SEQ ID NO: 424795 - DNA, 3513 bp, Homo sapiens
cctggtggcgaattcggcacgaggcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagctgggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaataaaaaatgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttttagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaagtggaggtgtttacaccagcaaaatactcattttttaagtgtaattaagttgaagatcaaaaaatggaaatgtataattaaatcatacttagcaaatctaacacatgaaatgtaacatctgcatatggagaaccgtgttactttattgaaaaacattaaaagtttgagaactt

SEQ ID NO: 424796 - DNA, 389 bp, Homo sapiens
ttaccacttactgttgattttgctgtcagcacagatcttgtatctcatccctgctgctactctagtccagaccatcctcatctcatacctggattattcagttctctactcactggtccctctgcttttcgttgcaccttctattccatgcactagcagcagctagagtaatgaacgtgtcagagcctgacctgcttataagcgttcccactccgtgtcaaagaggacagacttggtgccatggtttacacatccacctctgtgatttgccccctgccagcttcatctacctgaaagaaagaagctgagacaaaattgatttaagtagagagttcaggtgggccaggcttgaggctggcagcctaggggcatagactcaagttgccttg

SEQ ID NO: 424797 - DNA, 3376 bp, Homo sapiens
ctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattccaaaaaggatggaagaagaaggcaagaagggcaaactccagaagttctagtgcaggaagagagtttgagaagtaaaatccaggcaagcaaagcgttgtaccacttgggactccccaaagtgaaacagcaaggaaggattgtgtccatcttacttacttgaattggagagcttgtttctctctcatttttatttttcaatgatgttttctttatattttagagatattcattttctcttatcttgtgcttgtaaaaagcatttacatttcaagtctatgtgcttattacaggggaaaaataatctacctggttgcagtctttgagtataaacatttctaacctttttaaaacttctatagcagcccattaacactaacatttttagagcaaatatattctattttaacttcaggtagaggaatagtcctaaacttaatatgatagctctagataagatcttagagataagtgagcatttagtattctaaaagtggcagaacaaatcatgaggtttctggatgctataccaatttaaaatcaattcttatgttaatattgattgcttatttacatgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaacgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttacgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactacctgggttaggtctacctggccaggtagacctaacattactgctggccgcctactcatgcacctaatagcaagcgccaccctagcactatcaaac

SEQ ID NO: 424798 - DNA, 297 bp, Homo sapiens
ggcgatgaaggtggtagttcacacaagtaacagtggaggcaaaggtaagcgcaagctgcctgtcccagatgctggcccatgtgtgagtgcttccctggagaagtctgcttctgttgctcccacctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattcc

SEQ ID NO: 424799 - DNA, 3633 bp, Homo sapiens
ctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattccaaaaaggatggaagaagaaggcaagaagggcaaactccagaagttctagtgcaggaagagagtttgagaagtaaaatccaggcaagcaaagcgttgtaccacttgggactccccaaagtgaaacagcaaggaaggattgtgtccatcttacttacttgaattggagagcttgtttctctctcatttttatttttcaatgatgttttctttatattttagagatattcattttctcttatcttgtgcttgtaaaaagcatttacatttcaagtctatgtgcttattacaggggaaaaataatctacctggttgcagtctttgagtataaacatttctaacctttttaaaacttctatagcagcccattaacactaacatttttagagcaaatatattctattttaacttcaggtagaggaatagtcctaaacttaatatgatagctctagataagatcttagagataagtgagcatttagtattctaaaagtggcagaacaaatcatgaggtttctggatgctataccaatttaaaatcaattcttatgttaatattgattgcttatttacatgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaacgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttacgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccacggaaaaaaattcc

SEQ ID NO: 424800 - DNA, 1214 bp, Homo sapiens
tgactggaaaaccggaagtgaaatcgtggcagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctgctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctac

SEQ ID NO: 424801 - DNA, 679 bp, Homo sapiens
tgactggaaaaccggaagtgaaatcgtggcagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggagtcagtggaagttttccgacgaaccatacctttaacccttcagacaactttggctttgtgggcctgtttgctttggg

SEQ ID NO: 424802 - DNA, 2042 bp, Homo sapiens
tgactggaaaaccggaagtgaaatcgtggcagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424803 - DNA, 2185 bp, Homo sapiens
aggcatagattaggaggtgatggggaaaaggaatcagttggtggaaggacttggggtcaggcaaacaggttggaaggtctcagggttgatgctgtctataacccaaataccaaagatagaaaacaacctggctatcctatgccaatgagatcctgtgttacctgactggtgttgcacaccatctccttggctttccagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424804 - DNA, 1927 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaatatgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424805 - DNA, 2024 bp, Homo sapiens
tgactggaaaaccggaagtgaaatcgtggcagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctgctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424806 - DNA, 1924 bp, Homo sapiens
aggctggacgctcagacgctggcctcgcactcgttgacacgacacgtcatcgtgagcgcgcagccttctcactgtatgacacacgctatgcgagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424807 - DNA, 2346 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggagggtatgatgggactggtggctaaacagagaaggagaggtatataagatcactggaatgggaatggttgttttggaagtagtgaagttaggacacaagggtgaactgctttggggtttgtatccattctgttagccttttgtatttaaggccagcactgaagcagtggaggaaatgggcaaagtaagaagagagaattctgagataggcttgggggtcctctggctctttttctgggctgtgagggagtctagatgttgctgaattcagaactccaaaccctggcactcatactggtcttccagctgccacgttcagtcctgcatcagaagcatacttcaggatccccattactttttcttcaggtgtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424808 - DNA, 1488 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424809 - DNA, 1944 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424810 - DNA, 2213 bp, Homo sapiens
ggaaggggtacaacattcttacaccttgttaccaccaccaggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggagggtatgatgggactggtggctaaacagagaaggagaggtatataagatcactggaatgggaatggttgttttggaagtagtgaagttaggacacaagggtgaactgctttggggtttgtatccattctgttagccttttgtatttaaggccagcactgaagcagtggaggaaatgggcaaagtaagaagagagaattctgagataggcttgggggtcctctggctctttttctgggctgtgagggagtctagatgttgctgaattcagaactccaaaccctggcactcatactggtcttccagctgccacgttcagtcctgcatcagaagcatacttcaggatccccattactttttcttcaggtgtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424811 - DNA, 1549 bp, Homo sapiens
tgactggaaaaccggaagtgaaatcgtggcagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424812 - DNA, 1814 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424813 - DNA, 1101 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcgagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatg

SEQ ID NO: 424814 - DNA, 1981 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424815 - DNA, 2167 bp, Homo sapiens
aggcatagattaggaggtgatggggaaaaggaatcagttggtggaaggacttggggtcaggcaaacaggttggaaggtctcagggttgatgctgtctataacccaaataccaaagatagaaaacaacctggctatcctatgccaatgagatcctgtgttacctgactggtgttgcacaccatctccttggctttccagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctgctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424816 - DNA, 2145 bp, Homo sapiens
aggcatagattaggaggtgatggggaaaaggaatcagttggtggaaggacttggggtcaggcaaacaggttggaaggtctcagggttgatgctgtctataacccaaataccaaagatagaaaacaacctggctatcctatgccaatgagatcctgtgttacctgactggtgttgcacaccatctccttggctttccagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctgctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424817 - DNA, 1848 bp, Homo sapiens
ggaaggggtacaacattcttacaccttgttaccaccaccaggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424818 - DNA, 1981 bp, Homo sapiens
tgactggaaaaccggaagtgaaatcgtggcagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424819 - DNA, 2005 bp, Homo sapiens
tgactggaaaaccggaagtgaaatcgtggcagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 424820 - DNA, 1171 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctac

SEQ ID NO: 424821 - DNA, 2115 bp, Homo sapiens
tgactggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgcaaacacaaaaaaacaaaaacaaaaaacaaaaaaaaaaaaaaacaacaaagagggggacaaaaaaaaaacaaacaaaaacaacaaaaaaacagtgtcggggggcgccgcccggcccccccagaaaaacttgttcaaaacaacacggggggggggcggcggcggggccacacaaggatgaacgaaagaacacaagagtggggcaacaagcaggtgcgtaccacacagaaaagaaccgcggcggaacacaaagaagcgagggggggggcgcttctcccaccaacaaaaaaaagaagcggcgcggggggggaacacacagcaggcggctgttagcggaagaaaacacacaccagaacaggagggaggcagctacgaggcgagcgaacaccaacagaggaggggcgaaaaacaaacaacagagaggagagcagaccacaaaggagagcgcaagagaaataaataaaaaaacgcccccccgcccgggccgggggggcggctggacacgcacacgacagaacgaagaacacagaaaaccaaacaataagaaaaacgaccaacacaccaaagcaaggacgaaaaaacaaaagaagcaaaggaggaaaagagcagacagcaaccaacaaggaaacagaaaaagagcggagagaagaaacaagaaaaacaaccgaagaaacaccacacaagtgcaagaagggagaaaaagaaagagaggcgcagaaaagaagaggaagagcagggagcagagagagagaaagaagagagaagacaagagaacagaggaggcacgaaagcagagaacaaaaggaagggacggagagggcaagaggaagcagaagagaagagcgaggagagaagacgagagaggagagaggagcagaggacgagcgagagagagctagagagaagagaagaagagaaagagagcgaagggaaggaaaaaagaaagagaagacgaaaaaagaagagacacagaaagcaaaacagaacgagaaagagaagagagaagg

SEQ ID NO: 424822 - DNA, 949 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggtgagtacagtttctatactagtgactatgcattctggatgaattgtacggaatttaatgctctgggaaggatatgcttctcctttcccccaacctcctttcttctttctttctttttgagacagtgtctcacttaatcgcccaggctggagtgcagtggtgtgatcatggctcagtgcagccttgacctcctggactcag

SEQ ID NO: 424823 - DNA, 546 bp, Homo sapiens
ggtcacaggtggtggaatgtggtaaaagctatgttgacagagcagttataggaccgaacttcttagatttctgtatggtacaccacactctgaagaagaaaagaacccagttctatttgtgagttaactatgaatagcaaagttttgtgacttgtgactcacgttaaatcaccccatctgaaattcatttacaaggtttttacattaataaaacagtagtgtggtacatatattggactcagatgaagtctaaagtacactggactctagagagtggattacataccaacgaccaagattcaagtgagaagcaaagtagatatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatgtgacatggctgtggatagggaggctgggatgattggg

SEQ ID NO: 424824 - DNA, 215 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtaaggctcaggccatccgttatttcttccccatggcacttggggcacttggcgcattattgtagcttctgagcttaagccgggtgtg

SEQ ID NO: 424825 - DNA, 2323 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgctgctattttctttgttgagcatgtcccctccagtgcccttgaagcaccaagaacactaattccactggttgtgtaaaatcacatgcagaaagtcatcagtcctttcctgagctgtggttctagattcctagacagtaaggatgctctctagccagtgtgcccagtagagaagagaataatgatcctcactgatgggcaagaggtggatagaggaatgtaagtatgattggtctcaaatgtcagactcattccggcccatcttcaggcctagtccctggggaaagatttcctggggattgctgtcagcctgatgggctgctaatctgatctccaggctatgaaggactgggctctggatgaaggcatctaatgaaaatcacttatgggtg

SEQ ID NO: 424826 - DNA, 1930 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaatttatcagtcataggtgttccatatgtgctgcgcatgctcc

SEQ ID NO: 424827 - DNA, 2738 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccaggtatgtagttagaaggatggtgggcgcctttgggcagttattatttgttttacatgtatctccttccccactcctaaaaaatctatctcatttactgggccccaccctcctttagctgcagcagtagaaacagcagcattgagggtcatgagcagcttaactatttcagagtctttgcacaagatcaaatgacatagggtcaaaaatctattttttacttcctatagcaaagtgccaggctttgattcccatggtaggcagtaaacaagcatcaatgcataagtagaaagggcagaaaaaattgcagtctttggaaaataactaaattttattctagccaggattgaagttttcctctaagtcttaagcaaaattaaaaagaaaaaaaccactaatgccactaatagtgaagaagtctgtgttcttcccctgagttcactgtattgaaatagcatggtttaatcttggagccttgtttaatcctgcctctactgtttattagttttgtgaacttgccaagttctttcactgtttatgcctcagtttcctcatcaggaaaatggagagaaatatagttccctcttcatagattttatgagaattaagtgagatatgcatttagtgtacagaataatgcctgtcacatagtaagtatgtaataagcatttattattacttatcagggtatgatttatgaattgtggaacctgggattatgggagagtctggcttcaatcaagggctgaaattccatttccactgacatctcttccttccccatcccccgattctgtcctgcaacagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgc

SEQ ID NO: 424828 - DNA, 2761 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccaggtatgtagttagaaggatggtgggcgcctttgggcagttattatttgttttacatgtatctccttccccactcctaaaaaatctatctcatttactgggccccaccctcctttagctgcagcagtagaaacagcagcattgagggtcatgagcagcttaactatttcagagtctttgcacaagatcaaatgacatagggtcaaaaatctattttttacttcctatagcaaagtgccaggctttgattcccatggtaggcagtaaacaagcatcaatgcataagtagaaagggcagaaaaaattgcagtctttggaaaataactaaattttattctagccaggattgaagttttcctctaagtcttaagcaaaattaaaaagaaaaaaaccactaatgccactaatagtgaagaagtctgtgttcttcccctgagttcactgtattgaaatagcatggtttaatcttggagccttgtttaatcctgcctctactgtttattagttttgtgaacttgccaagttctttcactgtttatgcctcagtttcctcatcaggaaaatggagagaaatatagttccctcttcatagattttatgagaattaagtgagatatgcatttagtgtacagaataatgcctgtcacatagtaagtatgtaataagcatttattattacttatcagggtatgatttatgaattgtggaacctgggattatgggagagtctggcttcaatcaagggctgaaattccatttccactgacatctcttccttccccatcccccgattctgtcctgcaacagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424829 - DNA, 2411 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatgggtgagcggcattattcttcctctgtgggactggtgggaattgcttagtgtattgatcttatactgacccatttctccttccattgcagggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgctgctattttctttgttgagcatgtcccctccagtgcccttgaagcaccaagaacactaattccactggttgtgtaaaatcacatgcagaaagtcatcagtcctttcctgagctgtggttctagattcctagacagtaaggatgctctctagccagtgtgcccagtagagaagagaataatgatcctcactgatgggcaagaggtggatagaggaatgtaagtatgattggtctcaaatgtcagactcattccggcccatcttcaggcctagtccctggggaaagatttcctggggattgctgtcagcctgatgggctgctaatctgatctccaggctatgaaggactgggctctggatgaaggcatctaatgaaaatcacttatgggtg

SEQ ID NO: 424830 - DNA, 1996 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcactcattgcagaagagggagaaggatggaagttgatgggggtttgaagtcaagagaccaaaatactaatcactagttacaaccagggatgctccaccaaggatttgtctccccaggtttcttctacattcccacggtgcgcgatgttgtggggtgatctcaacgtatgggcgatcggggcctaactggtttggctaaaaaaaaaagggggcgaaatacgggggcaatcccctttaaggctagggataaaggggaaaagaaaagtgaacactttta

SEQ ID NO: 424831 - DNA, 1751 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtacggccggaggcggaaaccagggcccagggaacccatgaaacaaacctgacgccagggacagattacgcgacccgggggaccaacggaccgagggggaagccagaacccccaccagtac

SEQ ID NO: 424832 - DNA, 1540 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtatgtggaggtagcactctgtatgtgtaggtagcactctgtttgtggaggtatcact

SEQ ID NO: 424833 - DNA, 1533 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagacttctttttcttgtctttaaccacagactcatcatcactgtcgaccgaaggtgtcgtgctagggatgatggcggaggcggtgtctgacccactgtccttattcttccccttg

SEQ ID NO: 424834 - DNA, 1987 bp, Homo sapiens
gcttcttgtagtttcctatttcagcacttattacattgtgttgacactgtcgctgttctaacttttgttctgtattgttcactactatatctcaaatttttgcataggatctgacacgtaagagactgattaaattaacgtcaattttttttgtcaggtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424835 - DNA, 2242 bp, Homo sapiens
  misc_feature (515)..(515): n is a, c, g, or t
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagtttcctgaagtcttcattggtgagttatgatgggagcgagatagggagccgatctacgatcgcgttggtcgccggatggaacgggatgtggatggaggcctcactccttgccaccgagatctagaaagtcatcgaatgagaggactgcagtgagaacttgctcgaggnacgccagtgcctggagctgaccatctgtcaccggcttgctaagtcacgatcaccatgagatgccaagggagtacaaggaggatgaagacccagctgcacgaaggaggaaagacgaaattattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424836 - DNA, 1657 bp, Homo sapiens
gactggatactcctactaggtcaactctaacattgggggtcacatttcaacatgagattgaagacaaatatccagactatatccaccttctagaggggacagggacttctgctcctggaaattcagacccaggaataggacttggcattcttctgctccatcttatgcccactccccagccacacagatcacccttcgtgccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424837 - DNA, 1639 bp, Homo sapiens
ccgtggatcgtgccacggtaacggaaatatggagtgaacatatgattatgaacgaaaccgagtcttatctagacaccagcagacatacacttatacgagtgcgtgattgtgtcccccacttgcttagatggctgtgagcagaagtacaagcgtggcacgtacgcataaggagacaagaacagcttggagtcctaggtatgatccgaaaattctatggtgatggtgacgattggtaatcatcacctcattttggttgaataggtcttgtgaattttagactgctgtcatcaagacagtgtatcgatgctgtggtattgccagcatagtgatataagacggaagaggatctgatggaaaagccccagaaagaaacctagatggatgatggatcctgacaatataaattgaagtttaaacacacgtcttgggcgccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424838 - DNA, 1089 bp, Homo sapiens
  misc_feature (57)..(57): n is a, c, g, or t
  misc_feature (60)..(60): n is a, c, g, or t
  misc_feature (63)..(63): n is a, c, g, or t
ccgtttcaaaatatcatgtcagctcaggaggttcttctcttccagctccctttatcnttnttnttaagcttcttgttacgggttccctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424839 - DNA, 1058 bp, Homo sapiens
cagccttgacccacgttttaaacagaagatgtttaaaagggcattaagagctggagaggatggtgaagttcagtggaaattaactgaggagtatgttcctgactcctctctttaaatttcagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424840 - DNA, 1028 bp, Homo sapiens
  misc_feature (57)..(57): n is a, c, g, or t
  misc_feature (60)..(60): n is a, c, g, or t
  misc_feature (63)..(63): n is a, c, g, or t
ccgtttcaaaatatcatgtcagctcaggaggttcttctcttccagctccctttatcnttnttnttaagcttcttgttacgggttccctgcctcaggtatgaaaggatctgggtcagcttgctaatgacaatgtatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424841 - DNA, 930 bp, Homo sapiens
tacagtatacagagatggagacatccagcccacttctcctggaacaggggaaacataatcggggagggaacacaggtcagtctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424842 - DNA, 797 bp, Homo sapiens
catatactaaaattggaacgatacagagaagattagcatggcccctgcgcaaggatgacacgcaaattcgtgaagcgttccatatttttggaggaggttgtgagagcctcagttcaaggtctgggctgagttctcttttctcctaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424843 - DNA, 678 bp, Homo sapiens
ccactcagaattttcatgttggggcttctagccttggccccctcctggctgaagctttacagcaataggtagaatcctgtgtagtgttttctttaacatagcatatgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424844 - DNA, 1491 bp, Homo sapiens
ctgccctcctcagcctccaaaagtgcggggattacaggagtgagccactgcgcctggcccaaggctacttcttacttggatgaactattttattaggctctaagtgggaggtctagggggtggtcattcctatgcagataacctcttagtcgggtaggtttccagatgaagcatagggtcagggtatgcaacatctgtttaactcttgcttctccttaggatggatgacatggctgtggatagtgatgaggaggtggattatagcaaaatggaccaggtatgtagttagaaggatggtgggcgcctttgggcagttattatttgttttacatgtatctccttccccactcctaaaaaatctatctcatttactgggccccaccctcctttagctgcagcagtagaaacagcagcattgagggtcatgagcagcttaactatttcagagtctttgcacaagatcaaatgacatagggtcaaaaatctattttttacttcctatagcaaagtgccaggctttgattcccatggtaggcagtaaacaagcatcaatgcataagtagaaagggcagaaaaaattgcagtctttggaaaataactaaattttattctagccaggattgaagttttcctctaagtcttaagcaaaattaaaaagaaaaaaaccactaatgccactaatagtgaagaagtctgtgttcttcccctgagttcactgtattgaaatagcatggtttaatcttggagccttgtttaatcctgcctctactgtttattagttttgtgaacttgccaagttctttcactgtttatgcctcagtttcctcatcaggaaaatggagagaaatatagttccctcttcatagattttatgagaattaagtgagatatgcatttagtgtacagaataatgcctgtcacatagtaagtatgtaataagcatttattattacttatcagggtatgatttatgaattgtggaacctgggattatgggagagtctggcttcaatcaagggctgaaattccatttccactgacatctcttccttccccatcccccgattctgtcctgcaacagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgc

SEQ ID NO: 424845 - DNA, 537 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcgtgagtactgagggaacagggc

SEQ ID NO: 424846 - DNA, 1450 bp, Homo sapiens
ggtcacaggtggtggaatgtggtaaaagctatgttgacagagcagttataggaccgaacttcttagatttctgtatggtacaccacactctgaagaagaaaagaacccagttctatttgtgagttaactatgaatagcaaagttttgtgacttgtgactcacgttaaatcaccccatctgaaattcatttacaaggtttttacattaataaaacagtagtgtggtacatatattggactcagatgaagtctaaagtacactggactctagagagtggattacataccaacgaccaagattcaagtgagaagcaaagtagatatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatgggtgagcggcattattcttcctctgtgggactggtgggaattgcttagtgtattgatcttatactgacccatttctccttccattgcagggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgctgctattttctttgttgagcatgtcccctccagtgcccttgaagcaccaagaacactaattccactggttgtgtaaaatcacatgcagaaagtcatcagtcctttcctgagctgtggttctagattcctagacagtaaggatgctctctagccagtgtgcccagtagagaagagaataatgatcctcactgatgggcaagaggtggatagaggaatgtaagtatgattggtctcaaatgtcagactcattccggcccatcttcaggcctagtccctggggaaagatttcctggggattgctgtcagcctgatgggctgctaatctgatctccaggctatgaaggactgggctctggatgaaggcatctaatgaaaatcacttatgggtg

SEQ ID NO: 424847 - DNA, 404 bp, Homo sapiens
tggtaaaaattcagaagattttctgatttttgtgtggaaaagtcttatatctatagagaattggtagagttgggtggtattaaaaagttctgaagtgacagatggagtgtcccaagttggcactggaaaagtatatctataagctggaagaagttgtagttctgattttgagtaactacgaagaggtggccagcagttctatcaggacagacatgagcttttccccatagagagtaggttggagatgtagggaagcaagcaggaacagttctgttgaccttgaggtagcagctgatgagccttatacatttgcctttctctggtcacattattatgccaagctacgccaacaagaaattgagagagagagagagctagcagagaagtaccgggatcgtgccaag

SEQ ID NO: 424848 - DNA, 346 bp, Homo sapiens
gttctgaggaggtgaggtagaggtcaagtatggaatgttctggataccctaccctcatctcaaccagagtgactcattaattggagtttgtttaaaactttgttagacaaaagggttctatgccttaaaaatgttttttaagtgtgttgtggggaggaggttgtgagagcctcagttcaaggtctgggctgagttctcttttctcctaggacctgggtctaccaaggagttgatcaagtccatcaatgaaaagtttgctgggtctgctggctgggaaggcacagaatcatatcctttattttaatacgttcctgggttccagagaactggtctctttactccaacc

SEQ ID NO: 424849 - DNA, 1934 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgc

SEQ ID NO: 424850 - DNA, 1957 bp, Homo sapiens
cacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaaaaaaaaaaagaaaaactc

SEQ ID NO: 424851 - DNA, 3445 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaagggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatga

SEQ ID NO: 424852 - DNA, 627 bp, Homo sapiens
tcacaccctaatgcacgtgctcagctgatgattagaatgctcttctgacaggtatagtttctttgcactgtgtcctgttctttatcattgcttatcattcagtctggctcttcttcatcttgaatttcagaagagccagaatattaaaggtgctccttttgagtattctaagttaaactgtcttgagtcgtgtttgtaattttacttttttaatctctagaacacttcctcgtgggtactgtataacatggcttcattttactggagaattaagaatgagccatatcaggtagtagaatgtgccatgcgagcacttcacttctcttccaggtaagattcctcctcttctggacctgattttccacattcctcaggactgttaaagaaacaatacataagaaagcagtaagaagcaacattgcattatatacttttctccatccctgttcaaagaaataagtcccaccacaaaaaaaaaaaaaaaatcacagatctcaaaaagttcaaagtgataattgtgtaatatactttccatttccattaaggaaaaaatatgtagatgccctatgattcacatgatacttgaatggaattatcataaactaagtttaacttttcttaaagcaa

SEQ ID NO: 424853 - DNA, 624 bp, Homo sapiens
gaagtgtatagtatattgaaagaaaaaatggcgggtgcggtggctcacatctgtaatcccagcactttgggaggccagggtgggaggatcacttgagtccaggaggttaaggctccagaaagctagtatcatgccacggcactctagcctgggcaagaaagcaaggtgctgtctctaacttaaaaaaagaaaaatggaaaaaacttaaccacatgaggttaaaaaaagaaaaatggaaaaaacttaaccacatgaggttaaggatgtaaagcacttagcatgggatctgaatacacaggaagtgctcttcaaatagttgataaccaggctggttcttggactgtggtggtgtggtgggggctgggaggagatgataatctttcattaacatcattactccctgctgctcttctttatagtagtggttctctctactgggtgtggacatttggcaatatctggagacatttttgttgttatatctggggaacagtgctaccaccatccagtgggtgaaggccaaagatgatgctaaacaccctccaatgcacaggacaggtccctcaaaaaattatccagcccaaaatgccaataataccaggttgagaaaccctgctttagaga

SEQ ID NO: 424854 - DNA, 263 bp, Homo sapiens
atgatttgtttatgtttacaatacaacaggaaaagagctagagcgaagatatagaacaattgcacagaggaaagagtaactaattctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatga

SEQ ID NO: 424855 - DNA, 4653 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424856 - DNA, 4602 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaatctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424857 - DNA, 4809 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggcaagtggtgatggatttggcaaagcacctgattctgcatgattgtcatctagcggttctttgagagcaccagccttggacttgaaaagttaagtctttatcttgaagtcacccaaactttgaaaatatgaatcttgttcctttttcttgtgccaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424858 - DNA, 4960 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcagttatagccaggagcccatgcgtatctctctcaagagtggaagctgggctgctatttttgcgaacctgtacttctctaaacctcaaagaagatgtaagcccatgatggttagacttgaatcctgaagagataattccatgagaagtggagcaacagactttctgcctgcgtcattccatccctgtgaaactcatcttgcttgctaccatagtagcctggaagggatcgcaaacagaagggtctcttagacaatcatttgattgtttgagctagatttgtgataagggtaaaaatctgagggaagaaaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424859 - DNA, 4606 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424860 - DNA, 4533 bp, Homo sapiens
agtgaacggagagcgtagtgacctatcatgagcctcctcaacaagcccaagagtgagatgaccccagaggagctgcagaagcgagaggaggagtgaatttaacaccggtccactctctgtgctcacacagtcagtcaagaacaatacccaatgtgctcatcaactgccgcaacaataagaaactcctgggccgctgtgaaggcctttcgataggcactgcaacatggtgctggagaacgtgaaggagatgtggactgaggtacccaagagtggcaaggcgcaagaagaagtccaagccagtcaacaaagaccgctacatctccaagatgttcctgcagctggggactctatgtcatctgtggtcctgcggaacccgctcatcgccggcaagtaggggccgcctgtctgttgatgagcacttgggtattgtcctgggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424861 - DNA, 2156 bp, Homo sapiens
tttctactaagttggagttgtctttataaaatcaaaatacagaggggcaaaaattaagtttggtaagaatgttaacattgaagaatgccttaaccccttatttcatgttgatcaatcttaaatctagcaaaggactcatttattcttacttctccacctatctttactcagagatgatctttagttccattgcataatgacgagattttaattagatcatagatgggggaaatgttaaagactacaggaatgactagcacctccaaatacaccaatccaggtgaagtaatcaccagggcataaggccctttgggttctcttcctttgcaattgtgtggattcatggcatactttccttccaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424862 - DNA, 2353 bp, Homo sapiens
aaggaaatgcagattaaaaccacatttctcacccatcagattgtcaggggcctaagagtttagtaacaaactctgtgatggggctataaggaaatggtgatacttagatatttctggcaggagattaaattgttataatccgggtgggcatggtggcttatgcctgtaatcccagcactttgggaggccgaagtgtgcagatcacctgaggtcatgagttcgagaccagcctggccaacatggtgaaactctatctctactaaaaatacaaaaattagacaggcgtggtggtgcactcctctaatcccagctactcgggaggctgagacagaagaatcgcttgaacctgggagatgaaggttgcagtgagctgagatcattccactgcactccagcctgggcgacagcgagactctgtctcaaaaaaaaaaggacaaaggaaaggaggggggaggggggaggtgaggggaggaaattctagaaggaaacgtaaaaaattaaaaataatgtttacttgtctaccatagagacgaggatgggagagagacttcatggtataactttgtatacttcctggtttttgaaacgtgtgactgtgttacctattcagaaagttaaataaaatagaacatagatatgagatatagttctgctattcagtagttgagtgaacttgggcaagacacttaagctctctgagtcatagttttctcatttatagaagggctgtaatagtagtatcaagctcacaggattgttctaaggattaatgaaggacaggtggaacagaaagtgctgagcagagtgccagcacttagtaaatactcagttgaatggtcatgacttgtgttactgaacttaatcttggtaataaatgagtatgttcttgaaaggacaccagccttggctaacattcctttgcagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424863 - DNA, 4562 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaagggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatgaaattattaaatgtaaaagaaaattaagattttttgtgaaaattatggcttatttaagttattaatttaaacagagttaatttgaaactcttccaaaactgttcctttctgttttgttaaaatctcaatctaaacccctgcctgtacctcaaacagttttctactgttcgtaaattcctataatataaaaagcgctatacagaactaaagttctccttcctgcctattccattataactccttcagaaaacccttcccagacaagacagttctgctcttttcttggggatttgatgtaagtaaagggcccacacccaaaaggtggtacttacgaaggatattaataaacagagctttaaatttttttgtagctttaaatagcttgttgattgggaacatacacgttagagtcaaacagactcctagctctgccagttgctagccaggtgacctggacaagtcacttagtctctctgagtctctgttttctcatctgagaaatgagggttaaaacctacttcaggccagatgcagtggctcacatctgtaatcccagcactttgggaggccagggtgggaggatcacttgagtccaggaggttaaggctccagaaagctagtatcatgccacggcactctagcctgggcaagaaagcaaggtgctgtctctaacttaaaaaaagaaaaatggaaaaaacttaaccacatgaggttaaaaaaagaaaaatggaaaaaacttaaccacatgaggttaaggatgtaaagcacttagcatgggatctgaatacacaggaagtgctcttcaaatagttgataaccaggctggttcttggactgtggtggtgtggtgggggctgggaggagatgataatctttcattaacatcattactccctgctgctcttctttatagtagtggttctctctactgggtgtggacatttggcaatatctggagacatttttgttgttatatctggggaacagtgctaccaccatccagtgggtgaaggccaaagatgatgctaaacaccctccaatgcacaggacaggtccctcaaaaaattatccagcccaaaatgccaataataccaggttgagaaaccctgctttagaga

SEQ ID NO: 424864 - DNA, 2224 bp, Homo sapiens
gagttttaaacacagctctacctcttactagctttgtgaatttgggcaccttattgaacttcaatgagctcatctagagtcatgcattctatggctgtcacaaagatgggtcctttctgtttcttctgtgtctgctacagaacccaatatggcatgatacaggtaacagttgctcaagttagacatttaaagggaatgatatttgtgatgatagcaatcttgctacttgttccatccatcattttgtactctatactgttaggcaatagggaagggctgaggctctacctctgggagtcagcaaacttcccgaaaagggcaagagaataaaacacttggactctggaggccagacagcctctggtgcacctacttaattctagcattgtagtatgaaaacagccacagaaatacgtagaggactgggaatgattgtgtcctaataaaacttttttcaaaataggcaggagactaggtttggcctatgggccaaagtttgccaacccgtaatgatataatggttcttgcagaaattattttggctttctgacagcatgactctaagtgtggtctgtggacagtacacagactttttattagcagtctgcaatgagacaaggagcttcaccagaagaaaccaactacattattcagcagattgtttacttcagctgacattttgttgtgtttgttttcgaagcaagacttcgccaatgaaagaagtaattgatttatattctggtacaagcaccttatctatcacagaccagtagcaaacagcacaaaagcactttgagtggcactgttctaatcattcaccaggaaacacagactgtattctttatgatcaccaaaaacaagaatgaaagctcaaaacccaattttcccttctcaccattctccttcttctcccaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaaaaaaaa

SEQ ID NO: 424865 - DNA, 4512 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatgaaattattaaatgtaaaagaaaattaagattttttgtgaaaattatggcttatttaagttattaatttaaacagagttaatttgaaactcttccaaaactgttcctttctgttttgttaaaatctcaatctaaacccctgcctgtacctcaaacagttttctactgttcgtaaattcctataatataaaaagcgctatacagaactaaagttctccttcctgcctattccattataactccttcagaaaacccttcccagacaagacagttctgctcttttcttggggatttgatgtaagtaaagggcccacacccaaaaggtggtacttacgaaggatattaataaacagagctttaaatttttttgtagctttaaatagcttgttgattgggaacatacacgttagagtcaaacagactcctagctctgccagttgctagccaggtgacctggacaagtcacttagtctctctgagtctctgttttctcatctgagaaatgagggttaaaacctacttcaggccagatgcagtggctcacatctgtaatcccagcactttgggaggccagggtgggaggatcacttgagtccaggaggttaaggctccagaaagctagtatcatgccacggcactctagcctgggcaagaaagcaaggtgctgtctctaacttaaaaaaagaaaaatggaaaaaacttaaccacatgaggttaaaaaaagaaaaatggaaaaaacttaaccacatgaggttaaggatgtaaagcacttagcatgggatctgaatacacaggaagtgctcttcaaatagttgataaccaggctggttcttggactgtggtggtgtggtgggggctgggaggagatgataatctttcattaacatcattactccctgctgctcttctttatagtagtggttctctctactgggtgtggacatttggcaatatctggagacatttttgttgttatatctggggaacagtgctaccaccatccagtgggtgaaggccaaagatgatgctaaacaccctccaatgcacaggacaggtccctcaaaaaattatccagcccaaaatgccaataataccaggttgagaaaccctgctttagaga

SEQ ID NO: 424866 - DNA, 3321 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaagggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcagccgtcttaattattcctttctgtacccctagtgtcttttatggttctcagccccttataacaggtgctcaataaatatttttcaaatga

SEQ ID NO: 424867 - DNA, 4926 bp, Homo sapiens
  misc_feature (4902)..(4902): n is a, c, g, or t
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggtgagtgggactcagaaggtgggaacttctgcccctttgtcctttccattccccatggtttattctgccctttgaaccagcctccctcatgctcagccagtgaggacatattccaaggagagaatggggcaggagaccttctgactgggcttgtgccccagcaagcctatgaactatccctgctgccttcccagcttcagcaggttggaacgtggggaaggccttccagatcactgtaagacagtactgcatttagtcccctttctgctgtgttcagagccacccaacatacagcaaatgcactggcctaagtgggctgacacatagaagtcaatctgaatttagcttgtcatcaggggcctggtgacctcttagacttgttttgcttatcctcttggcttgagcttgcttccaagcacagagatagaagcaaatttccatttattcatgtacattggccagttcctggtccttgtctgacttctactttttccacaaaaaaaaaaaaaaaaaaaaaaaaaaaccgggttacccctgtgtgcccccaggattttcccaaaaaaccgggttttggtaatgaggggggaaaaaattacaggggtttcattcaggcaactttgggtgtttccatggtggtcccgaggttcctgggttaaatcccagagattactatatggctctttaaaaaaagccatggggcggggagtctaacttgggtgccgcacaagggcaaatgcgtctggagaactggattgggacagggaaccaccgaggggattcttatgtggggtcagaggccatgtgcgcagtgaaagtcttttatacaaacccacgaggcctctatacctctctttatacatagcctctggggggaaattgtggggggccaccccttttattggggaccttccgaagggggagcctcccattctatagggagttcagtgccaatctcctataggggggggtggttcccaaagacagagatgtggcggtcccccatcatccgggggtggaatcatccatcgcgggggggtctccggggcacccaaacaggaaaaaccccacaaatatagtggcggccgtgtgatataacacgggggggtgcaaacccagagtctggcgccccccaaatgcttttcgagagaacccactttttaggaggggcggcaacagtgaacaacaattcacgaaggagcaaagagaaatagaaccaactctcgtgaggcaccatacacttgtggttccacaactcccgaaatcaaaattggtggggaacaccacaaaaaaaccgtgcgtgaacaggagcacaaatcggggaggaacaggggcccctagcgaggggccccctacaccatctgtgggaggacgactccaggcagaaaaagttttccgcagggaaaaagggagggcaccaggaaaacattaacaacccccgtctgggtgaccctcgagggagaggcagcacacgaaaaaagcagctcgctgggtggtgccacccatcacatataataatgttcgtaggcgcaactgtgaggacagctttatgtagaaaaancgaggcgccacagaacaaatagcc

SEQ ID NO: 424868 - DNA, 3395 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatga

SEQ ID NO: 424869 - DNA, 2993 bp, Homo sapiens
  misc_feature (2973)..(2973): n is a, c, g, or t
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaagggctactagactggaagaccaggaaagtgccatagacataatgtaactggatttcagcaaggcatttaacagagcctcttatgatatccttgtgaaccagatggagagatcagngaaaggggatccaaagagtc

SEQ ID NO: 424870 - DNA, 4124 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggcctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatgaaattattaaatgtaaaagaaaattaagattttttgtgaaaattatggcttatttaagttattaatttaaacagagttaatttgaaactcttccaaaactgttcctttctgttttgttaaaatctcaatctaaacccctgcctgtacctcaaacagttttctactgttcgtaaattcctataatataaaaagcgctatacagaactaaagttctccttcctgcctattccattataactccttcagaaaacccttcccagacaagacagttctgctcttttcttggggatttgatgtaagtaaagggcccacacccaaaaggtggtacttacgaaggatattaataaacagagctttaaatttttttgtagctttaaatagcttgttgattgggaacatacacgttagagtcaaacagactcctagctctgccagttgctagccaggtgacctggacaagtcacttagtctctctgagtctctgttttctcatctgagaaatgagggttaaaacctacttcaggccagatgcagtggctcacatctgtaatcccagcactttgggaggccagggtgggaggatcacttgagtccaggaggttaaggctccagaaagctagtatcatgccacggcactctagcctgggcaagaaagcaaggtgctgtctctaacttaaaaaaagaaaaatggaaaaaacttaaccacatgaggttaaaaaaagaaaaatggaaaaaacttaaccacatgaggttaaggatgtaaagcacttagcatgggatctgaatacacaggaagtgctcttcaaatagttgataaccaggctggttcttggactgtggtggtgtggtgggggctgggaggagatgataatctttcattaacatcattactccctgctgctcttctttatagtagtggttctctctactgggtgtggacatttggcaatatctggagacatttttgttgttatatctggggaacagtgctaccaccatccagtgggtgaaggccaaagatgatgctaaacaccctccaatgcacaggacaggtccctcaaaaaattatccagcccaaaatgccaataataccaggttgagaaaccctgctttagaga

SEQ ID NO: 424871 - DNA, 3090 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggtaaatttgaatgtttaatatgccagtttcttgttttagatgtcactatctcatttctcacaaaggttgtatttgtaacttgaaatagttcagatgagatgataaaggggcaaagtgtggtcaagaaaccagtctatcttctgtatcaatgaaaaaaatgttcaaactctaaaacattatggaaatgcaaattccagtggatttaacattatgtgtaataaatcataaagg

SEQ ID NO: 424872 - DNA, 2826 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagaatcagaaactccaacattttggaatcttcaagggcacatactgagaaaaaaaataaaattgtttatgagcaaaaaaaaaa

SEQ ID NO: 424873 - DNA, 2684 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcccgtcttaattattcctttctgtacccctagtgtcttttatggttctcagccccttataacaggtgctcaataaatatttttcaaatga

SEQ ID NO: 424874 - DNA, 1780 bp, Homo sapiens
agcggccgctcgcgatctagaactagtagcaaacctagagatcactggccccaaggtggcatctcctgggccacaagggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatgaaattattaaatgtaaaagaaaattaagattttttgtgaaaattatggcttatttaagttattaatttaaacagagttaatttgaaactcttccaaaactgttcctttctgttttgttaaaatctcaatctaaacccctgcctgtacctcaaacagttttctactgttcgtaaattcctataatataaaaagcgctatacagaactaaagttctccttcctgcctattccattataactccttcagaaaacccttcccagacaagacagttctgctcttttcttggggatttgatgtaagtaaagggcccacacccaaaaggtggtacttacgaaggatattaataaacagagctttaaatttttttgtagctttaaatagcttgttgattgggaacatacacgttagagtcaaacagactcctagctctgccagttgctagccaggtgacctggacaagtcacttagtctctctgagtctctgttttctcatctgagaaatgagggttaaaacctacttcaggccagatgcagtggctcacatctgtaatcccagcactttgggaggccagggtgggaggatcacttgagtccaggaggttaaggctccagaaagctagtatcatgccacggcactctagcctgggcaagaaagcaaggtgctgtctctaacttaaaaaaagaaaaatggaaaaaacttaaccacatgaggttaaaaaaagaaaaatggaaaaaacttaaccacatgaggttaaggatgtaaagcacttagcatgggatctgaatacacaggaagtgctcttcaaatagttgataaccaggctggttcttggactgtggtggtgtggtgggggctgggaggagatgataatctttcattaacatcattactccctgctgctcttctttatagtagtggttctctctactgggtgtggacatttggcaatatctggagacatttttgttgttatatctggggaacagtgctaccaccatccagtgggtgaaggccaaagatgatgctaaacaccctccaatgcacaggacaggtccctcaaaaaattatccagcccaaaatgccaataataccaggttgagaaaccctgctttagaga

SEQ ID NO: 424875 - DNA, 1802 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcaggtctttttcttggtccagtctaattcttataaacgtttgctttataaagattttttaaaacttttgtttttcctcttgattctttgtatatttgatccctaaaatttgtgattgtcatttagatctttaagattttgaggctgggcacagtggctcacgcctgtaatctcagcacttagggaggcagaggcagaaggatcacgagcccaggagttcaagaccagcctgggtaacatggtgaaaccccatctctacaaaaacatatataaattggccaggtatggtggcatgcacctgtagtcccagctactcgggaggctgaggcgggagaatcatctgagctctggaggtcaaagctgtagtgaacccagatcatgccattgcactccagcctgggcaacagagcaagactgtgtctcaaaaaataaataaataaataaataaata

SEQ ID NO: 424876 - DNA, 2626 bp, Homo sapiens
  misc_feature (2602)..(2602): n is a, c, g, or t
aaggaaatgcagattaaaaccacatttctcacccatcagattgtcaggggcctaagagtttagtaacaaactctgtgatggggctataaggaaatggtgatacttagatatttctggcaggagattaaattgttataatccgggtgggcatggtggcttatgcctgtaatcccagcactttgggaggccgaagtgtgcagatcacctgaggtcatgagttcgagaccagcctggccaacatggtgaaactctatctctactaaaaatacaaaaattagacaggcgtggtggtgcactcctctaatcccagctactcgggaggctgagacagaagaatcgcttgaacctgggagatgaaggttgcagtgagctgagatcattccactgcactccagcctgggcgacagcgagactctgtctcaaaaaaaaaaggacaaaggaaaggaggggggaggggggaggtgaggggaggaaattctagaaggaaacgtaaaaaattaaaaataatgtttacttgtctaccatagagacgaggatgggagagagacttcatggtataactttgtatacttcctggtttttgaaacgtgtgactgtgttacctattcagaaagttaaataaaatagaacatagatatgagatatagttctgctattcagtagttgagtgaacttgggcaagacacttaagctctctgagtcatagttttctcatttatagaagggctgtaatagtagtatcaagctcacaggattgttctaaggattaatgaaggacaggtggaacagaaagtgctgagcagagtgccagcacttagtaaatactcagttgaatggtcatgacttgtgttactgaacttaatcttggtaataaatgagtatgttcttgaaaggacaccagccttggctaacattcctttgcagaaccagacgtcctgggtcctctccagcatggcagccctctactggagggtgaaaggccaaggaaagaaggcaatcgactgcctccgccaggctctgcactatgcgccacaccagatgaaggtgagtgggactcagaaggtgggaacttctgcccctttgtcctttccattccccatggtttattctgccctttgaaccagcctccctcatgctcagccagtgaggacatattccaaggagagaatggggcaggagaccttctgactgggcttgtgccccagcaagcctatgaactatccctgctgccttcccagcttcagcaggttggaacgtggggaaggccttccagatcactgtaagacagtactgcatttagtcccctttctgctgtgttcagagccacccaacatacagcaaatgcactggcctaagtgggctgacacatagaagtcaatctgaatttagcttgtcatcaggggcctggtgacctcttagacttgttttgcttatcctcttggcttgagcttgcttccaagcacagagatagaagcaaatttccatttattcatgtacattggccagttcctggtccttgtctgacttctactttttccacaaaaaaaaaaaaaaaaaaaaaaaaaaaccgggttacccctgtgtgcccccaggattttcccaaaaaaccgggttttggtaatgaggggggaaaaaattacaggggtttcattcaggcaactttgggtgtttccatggtggtcccgaggttcctgggttaaatcccagagattactatatggctctttaaaaaaagccatggggcggggagtctaacttgggtgccgcacaagggcaaatgcgtctggagaactggattgggacagggaaccaccgaggggattcttatgtggggtcagaggccatgtgcgcagtgaaagtcttttatacaaacccacgaggcctctatacctctctttatacatagcctctggggggaaattgtggggggccaccccttttattggggaccttccgaagggggagcctcccattctatagggagttcagtgccaatctcctataggggggggtggttcccaaagacagagatgtggcggtcccccatcatccgggggtggaatcatccatcgcgggggggtctccggggcacccaaacaggaaaaaccccacaaatatagtggcggccgtgtgatataacacgggggggtgcaaacccagagtctggcgccccccaaatgcttttcgagagaacccactttttaggaggggcggcaacagtgaacaacaattcacgaaggagcaaagagaaatagaaccaactctcgtgaggcaccatacacttgtggttccacaactcccgaaatcaaaattggtggggaacaccacaaaaaaaccgtgcgtgaacaggagcacaaatcggggaggaacaggggcccctagcgaggggccccctacaccatctgtgggaggacgactccaggcagaaaaagttttccgcagggaaaaagggagggcaccaggaaaacattaacaacccccgtctgggtgaccctcgagggagaggcagcacacgaaaaaagcagctcgctgggtggtgccacccatcacatataataatgttcgtaggcgcaactgtgaggacagctttatgtagaaaaancgaggcgccacagaacaaatagcc

SEQ ID NO: 424877 - DNA, 1775 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagcttattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcaggtctttttcttggtccagtctaattcttataaacgtttgctttataaagattttttaaaacttttgtttttcctcttgattctttgtatatttgatccctaaaatttgtgattgtcatttagatctttaagattttgaggctgggcacagtggctcacgcctgtaatctcagcacttagggaggcagaggcagaaggatcacgagcccaggagttcaagaccagcctgggtaacatggtgaaaccccatctctacaaaaacatatataaattggccaggtatggtggcatgcacctgtagtcccagctactcgggaggctgaggcgggagaatcatctgagctctggaggtcaaagctgtagtgaacccagatcatgccattgcactccagcctgggcaacagagcaagactgtgtctcaaaaaataaataaataaataaataaata

SEQ ID NO: 424878 - DNA, 1908 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaaggtaagtcatcagtcacttaaagagccagcgggctgagccagcgggctctgtgtaaacagaagatatttttatcttggaaaatacctgactaatttgtttttatctagaagacgatttaaaattacacttacattgatgcaaattgcatagttcagtgctggggagaaatatggatagactagtctcctttcccaggaagagatgctggaaagttttatctaaactgatgaaaaacgaaatataaactgacataagcaacagcgtttataggctggattatatacattgtgtaagtaagaaagttaatgttttagtgtcgttaatatatctatacacaatacatgtattattactgttttctgagacagaaaaagaatcaccaccagcaacaaaatcttctgtaactttcttttaagagactatctactttaaaaaaaatgaaatagggaattatgtaacaggacccaggaatgtaaatgtatcattcaggattaacgtgggcatttagaaaatgtttttgctattctttgtgcctaaagagtatcataaaatgcagtttagtttctaagcagtattatagtggtataaaataagatgtataattgccacctttgtatacagttttttcaaatacatagctttgtatattgagaggaattttcagataaaagtccgataataacttgactttcagatgctttatatggttatttctgtagctgtgttaccatcttcatcttatttttctgaaggtaatgtaaaacttttacattcccagaacttgatgagtaataagagaaaactggcccaggattttacagtgtccttcagagaatggttagttgagagtagaccatagtggtaagtgttctatagaaaattaaaacagaaagtaactgggtggctactttagatctagcagttggggttatcctatccggaaacgtgaaatttaagctgacacctgaatcataagaagaaaccaaaattcaaagaccacggaagagcattctaagccacagcaaaggctctgaatcctgattgaggttaggtggttgtatttgtctgctcaggcttccataacaaagtaccactttggaccgtttctgctcaaaacacttctgacaccaaatgtatggagttttttctcacacgactaattcggtagttctcccgacatcaactaggtgttctacaactcaatacaattctgacactaact

SEQ ID NO: 424879 - DNA, 1093 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggtaagattcctcctcttctggacctgattttccacattcctcaggactgttaaagaaacaatacataagaaagcagtaagaagcaacattgcattatatacttttctccatccctgttcaaagaaataagtcccaccacaaaaaaaaaaaaaaaatcacagatctcaaaaagttcaaagtgataattgtgtaatatactttccatttccattaaggaaaaaatatgtagatgccctatgattcacatgatacttgaatggaattatcataaactaagtttaacttttcttaaagcaa

SEQ ID NO: 424880 - DNA, 1614 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacgccctgcctgtacctcaaacagttttctactgttcgtaaattcctataatataaaaagcgctatacagaactaaagttctccttcctgcctattccattataactccttcagaaaacccttcccagacaagacagttctgctcttttcttggggatttgatgtaagtaaagggcccacacccaaaaggtggtacttacgaaggatattaataaacagagctttaaatttttttgtagctttaaatagcttgttgattgggaacatacacgttagagtcaaacagactcctagctctgccagttgctagccaggtgacctggacaagtcacttagtctctctgagtctctgttttctcatctgagaaatgagggttaaaacctacttcaggccagatgcagtggctcacatctgtaatcccagcactttgggaggccagggtgggaggatcacttgagtccaggaggttaaggctccagaaagctagtatcatgccacggcactctagcctgggcaagaaagcaaggtgctgtctctaacttaaaaaaagaaaaatggaaaaaacttaaccacatgaggttaaaaaaagaaaaatggaaaaaacttaaccacatgaggttaaggatgtaaagcacttagcatgggatctgaatacacaggaagtgctcttcaaatagttgataaccaggctggttcttggactgtggtggtgtggtgggggctgggaggagatgataatctttcattaacatcattactccctgctgctcttctttatagtagtggttctctctactgggtgtggacatttggcaatatctggagacatttttgttgttatatctggggaacagtgctaccaccatccagtgggtgaaggccaaagatgatgctaaacaccctccaatgcacaggacaggtccctcaaaaaattatccagcccaaaatgccaataataccaggttgagaaaccctgctttagaga

SEQ ID NO: 424881 - DNA, 662 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcagttatagccaggagcccatgcgtatctctctcaagagtggaagctgggctgctatttttgcgaacctgtacttctctaaacctcaaagaagatgtaagcccatgatggttagacttgaatcctgaagagataattccatgagaagtggagcaacagactttctgcctgcgtcattccatccctgtgaaactcatcttgcttgctaccatagtagcctggaagggatcgcaaacagaagggtctcttagacaatcatttgattgtttgagctagatttgtgataagggtaaaaatctgagggaagaaaggtaaggagcaagaaaatacaaaagatgtttcatttttgagatgttctaccttggtccttatctgtgagaggaattttttttctctataagtgaatacacgagggaaaaatacaagattcttcctcagacctaagcttatatttgtcattacagtttgtttaaggaaaaaaaaa

SEQ ID NO: 424882 - DNA, 528 bp, Homo sapiens
ctgtaatcccagttattctggagactgaggcagggtggaggggaggaatcacttgatgccaggagttcaaatctagcctgggcaacacagcaagacccagtttctaaaactaaattagccaggcatggtggcgtgtgcctgtagtcccagatactccccaggagactgaggcaagaggaccccttgagcccaggagttgagcccaagagtacaaggctgcagtgagctacaatcaggcctctccatccagccttgacaacagagcaagaccccattttttaaaaaagttgtatttaaaggaagaatttcacatttatctttttgccctagtattcttgaactggtgatacagggttgtatgttaaataaaaggaaaacacacagtaattgttgctgagaaccagaaaaatctgtgcatttaagtgggtttaaaatttatgattttatagctctaactttttcctggtattaaaaaatgttaagatctctccagcgaacactgaatgagttaaaagagtatcaaaagca

SEQ ID NO: 424883 - DNA, 354 bp, Homo sapiens
tgctaacatttacatgtgatcactttgaaatactccttgagttttgctgaggaataacgctgattacaatggcgaatgaacaataatttaaagcatattaatgactttgttaatccaaaccagcattaatgaaatccgagctttatttatttattgcttgcttgcaggtggattcaccaatgaacttgaagcatcctcatgacctagtcatattaatgagacaagaagcaacagttaactacctcaaagaattagaggtgaggcaactgggcatgtgagatgcagctgatgcttgttgcatttcacaggagccattgtgttcaaagaaaagctaaagcatattattttttaagt

SEQ ID NO: 424884 - DNA, 571 bp, Homo sapiens
ctttcagttggtctctcacttataaagaccatttctctttcttctctccttcctgacagctttgtaattttatagacatctcttatttcttaaaattccaaaatattagtatttcaaaataaacactacaagatactgaattatttgtcatcttttatatcctttgatatgtcttttgaatctttttcttctcttcagggtggtgtacaggagagagttaatctttctgcacctctgctacctaaagaagacccaatcttcacatatttatctaaacggttaggaaggagtatagatgacataggtcacctcattcatgaaggcctacagaaggtaagtcatcagtcacttaaagagccagcgggctgagccagcgggctctgtgtaaacagaagatatttttatcttggaaaatacctgactaatttgtttttatctagaagacgatttaaaattacacttacattgatgcaaattgcatagttcagtgctggggagaaatatggatagactagtctcctttcccaggaagagatgctggaaagttttatctaaactgatgaaaaacgaa

SEQ ID NO: 424885 - DNA, 386 bp, Homo sapiens
caattacattagtcagtaaaatttccctgtaactataacgcttgggtccctgctaaaagggagtttagagaacactacctagatctaaggctgaagggcatcctctgacctcccattctaaattagaatttgaaagccacagaggagtgtgtacctcctttgaagagcacacaccgtcccatgaaaaccactctcagggtcttgcccagaagtgcctccagcacagggtttggaagcagatagtcgaagcatagcagccccagatgtgaaagcaaggaaaaagtgctagctgtgcctgagtgcagcagctgaaagaaaggtaaaataggacttgatttttgtgactgtggaacaatagcttttgccactcatgacacgtgactcag

SEQ ID NO: 424886 - DNA, 336 bp, Homo sapiens
caaaggctatatctttagagtaaaggcaaactagaaataaacctaccttcccagggaactgcagtgaaaatttcttgtctcaagtgctgtcactgactagaagaagaaaaatgctgtcctgagaattataactgcagctggctttcatgcaggtttgcagtcttagttcatattatcaagggtgaccgaaggaccccaagctgagaatttcctcaacagagatctggttttgtaatgctccacagcatatggcagaagtgaagacagattcattctggaagcacatactatataggcctcaagtaatttctgcagataaacttaaaagaaatggac

SEQ ID NO: 424887 - DNA, 6696 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccatcgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagagccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcagacatcggtggactctgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgccatcgtagttaccagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttgggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaaga

SEQ ID NO: 424888 - DNA, 6666 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccatcgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaagccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagagccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcagacatcggtggactctgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgccatcgtagttaccagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttgggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaaga

SEQ ID NO: 424889 - DNA, 6642 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccatcgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagagccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagctctgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgccatcgtagttaccagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttgggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaaga

SEQ ID NO: 424890 - DNA, 1176 bp, Homo sapiens
tcatagccgactcctgagggtaaaccgaatgctcggacccaccctagcatgcagacagcgttgttcttctgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgccatcgtagttaccagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttgggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaaga

SEQ ID NO: 424891 - DNA, 5976 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccatcgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagagccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcagacatcggtggactctgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgccatcgtagttaccagagttgggggcctctgagtgtgtctggctctgagagagtctgagtcttgcccaaacattctttcttatgttttagattgtgtgtccccacccaccccaaccagtcctgatttccacctgccaaggactcctctag

SEQ ID NO: 424892 - DNA, 4819 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtaaggatggccccaccccagaaggaattgtccgttcccttcctcaatacagtctgccacgccttcttcacctgctcatgccccgtggtcactgtggcagcgtgcacacagcagactctacagttcccgtaaccaccccacctgttcttgagagcatcgatatctcctcgcctagccatattttagtggaaatgctgtgtaatcacgaccaactctagcttatcaaaaaaccagaatgaagatttcatttcttcttacaatgtatttaaattcagtcatagctgtgctgttttgacaatgctttgtgttaaccaagtgaaaagttgaagacaaattccagtctacataaacttttttaaa

SEQ ID NO: 424893 - DNA, 3604 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagagctttgaatggactgaagcggcaccttctatcattgtaaataaacctctccaaagctccatgaaagccgagatccttgccggcccctccagctctgtaaccccagtttgcatcatgcaccgctcatgactcagtatcaagaagcaccattgttgcatgggtttccttcccctgtttggacacccggagggtcttgcttcgtctctttctgcctccgtttcactaatttctcactgctgtcggtgttcctttcataagtccttttgagaagagttctgaaattgcattggtgttgccacgtcatcagtctctgtttgtcattttataaatacctctgcaatatctcgactgttctaaggcttggccaactccatgctgctagctgaggttagagattccagaaagagtttcagaaggtggcagctgctcttatat

SEQ ID NO: 424894 - DNA, 3174 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaccaactgcatgacatcagttccatcacaactgcaggagaatggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtg

SEQ ID NO: 424895 - DNA, 1042 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatttagggttgatggtcctcgagaca

SEQ ID NO: 424896 - DNA, 757 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagaaacgcaactacctgagaagaaacgcaactacctg

SEQ ID NO: 424897 - DNA, 487 bp, Homo sapiens
aacccgtgttgtgtgtgtgtgtttcctttgcagaatatgtggatcgagagaaccatatatacaactgcatataaattacctggaattttaaggtggtttgaggtcaagtctgttttcatggtaaggatggccccaccccagaaggaattgtccgttcccttcctcaatacagtctgccacgccttcttcacctgctcatgccccgtggtcactgtggcagcgtgcacacagcagactctacagttcccgtaaccaccccacctgttcttgagagcatcgatatctcctcgcctagccatattttagtggaaatgctgtgtaatcacgaccaactctagcttatcaaaaaaccagaatgaagatttcatttcttcttacaatgtatttaaattcagtcatagctgtgctgttttgacaatgctttgtgttaaccaagtgaaaagttgaagacaaattccagtctacataaacttttttaaagattttt

SEQ ID NO: 424898 - DNA, 409 bp, Homo sapiens
cggtgtaatgaaagggtggttttaaatcaccaatcaggtattgccttttctaacccatgaatcaagatctaaaattgcaggactcatcctggaaggttccaggtcagtgtaatccaagactattagtgcaacacagaatttcagcttccggagataattccttttgctatgcactattctgatgtcatttcacatgtggttgactttattgcttaattcttcaattcgaaaggagcttctgatgaaagctcttggctctattgggattgttgaacagctcactggggagttagagctatcggggttccttcttggcagcagataacccctgtcttcttccgggcaggagctttgaatggactgaagcggcaccttctatcattgtaaataaacctctccaaagctccat

SEQ ID NO: 424899 - DNA, 403 bp, Homo sapiens
aagtccttttgagaagagttctgaaattgcattggtgttgccacgtcatcagtctctgtttgtcattttataaatacctctgcaatatctcgactgttctaaggcttggccaactccatgctgctagctgaggttagagattccagaaagagtttcagaaggtggcagctgctcttatatcctgtgagtctgtatctcactttcaaggcaaatccaaagcacatcatctctggagagtaagaattatagtcataagctgggctctggtgctcagccagtagtggtaataccagctacttaggaggctgaggcaggaagatcacttgagcccaggaggtcaaggctgcagtgcaccacgatcatacctgtgaattgccatgcactccagcctgggcaacatggc

SEQ ID NO: 424900 - DNA, 741 bp, Homo sapiens
agcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatctcttctatgagattttgattagaatggctttgaatttatagattaatttgagaacaactgatccctttatgctaggagtcttcttacttgtaaacgtggtccatttttccatatatttattagattagctttaatacctgtttgtataattttgtaattgttttcataaaggtagcctttgtagcttcttataatgttattttgtcatgataattgaaagcaatcatcaatttttttgttttttgttttacagctaaggataaatctgagaaaatatttgcactagcatttgtcaagctgatgagatacgatggtaccaccctgcgagacggagagcacgatcttatcgtctataaggtatctggttgcattggtgcaatattgctgctatagacagtttcagtcttttctgggctccctgacctggaccaacctttcccatcattgtgaggaagctgctatctagctacatttaattatgcaaatgaacatttccaatgaccagcccttttgttgttcctaacggg

SEQ ID NO: 424901 - DNA, 6712 bp, Homo sapiens
gcacgagcggctccggcggcgccatgacgcgctgggtgcccaccaagcgcgaggagaagtacggcgtggctttttataactatgatgccagaggagcggatgaactttctttacagatcggagacactgtgcacatcttagaaacatatgaagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccatcgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagagccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcagacatcggtggactctgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgccatcgtagttaccagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttgggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaaga

SEQ ID NO: 424902 - DNA, 6678 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagttttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccatcgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagagccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcagacatcggtggactctgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgccatcgtagttaccagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttgggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaaga

SEQ ID NO: 424903 - DNA, 3119 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattgtaagtgcttggtgacatatgtttggatatttaactggggctgacagcatccttctccaactgctgtttgaacatagcttattatactgcaatgtagtgagcagttgagatacagcttggtatataaaatgtcctcattttccaaatgaatgtcaaagttgaagggtaagcaaaccaactttaaagatggaaacatttggctcttgttttctcattacttacttatagcaaaagacatgtattttctgctgagtcgtcattcttctggcagtttctccatagtgtttacacttaaggtgccattaataaaattttatgaaggacccta

SEQ ID NO: 424904 - DNA, 3347 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataagtaagtgtggggaaaacggctctcaccttttctatggctcccaattcatgtctgctgggaacagtggtgttgcctggagaccaagctggcttcaataaaatgctctgcaaacgctgttcctaattctgtgctgcagacagttctagggagacagggactctgagtttgtggtgacttccttatgacaacacagggctctggctctaagaacttgagctccgtcccctggagaaaaacagcctgaagctggatctcccctagctgtcatcatgggcacaggggttctgctcgacgtcgctctgcgctctcatgttacccacatatttgtatcagccctaggcactgtcagctccatgcaa

SEQ ID NO: 424905 - DNA, 2855 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcgaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggatacttcgtggcttgcatgacagctattttacgacattgtgatttaagactcggtagattca

SEQ ID NO: 424906 - DNA, 1187 bp, Homo sapiens
tgggttccctgaaaaatgctggtgacacactgacctcactggttctgccaaccagtgagttctacacatcatgaatgtattgtgaggaccctaacatgtctctttgtactaactgtttcaactttgtgtttgtttagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagacataataaatggaaaagtagatgatgaagataagcagcatttcattccctttcagccggtggcaggggagaatgacttccttcagactgttataaacaaagtcatcgctgccaaagaagtcaaccacaaggggcagggctgcgtcgacgcggccgcgaatttagtagtagtagtcgacc

SEQ ID NO: 424907 - DNA, 322 bp, Homo sapiens
gtcggacaggatggagcccaactcatgtggggaggatggttccggctgagtggctgtgccaggtcagaccccacctggagacggtgtcttttctgtcaggacatcagttatgtgacatcttccccatcctcatgttttttagcatctgccacctccactgcccagcaaaactccgcctcctccccctccaaagacaactcgcaagcagacatcggtggactctgggatcgtgcagtgacatcgcaaggctctctggaaagagtgtgctgcccctccccatctccatgccctctccttctgtgtcccctgagtctgctgttta

SEQ ID NO: 424908 - DNA, 3051 bp, Homo sapiens
  misc_feature (2240)..(2240): n is a, c, g, or t
tccaggggaaaccggcctgggtggagagacagagaaggggagaccgggtgggtgggtcgtacgcttagggggccgtggttggtacttcgctgttggggaggctttcaggtcgcccagatcctgcttcccaatgggtgactgggaaaattagcgggtggaaaatctcgaggggtggaggctttttttttcctccttggccccgccctcttcctgttcggcgactgggacgcctggccctacgagggggaagggaggcttggccgggctatcggagagcgctgtgcgcacgcgcgagcccgagtgcgtgtgtgtgtgtgcacgcgcacgcgcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgatctttcactgctttctctgacttgtcctctttgtcttccctntttcttcctcgtttctttcgttcttcctcttctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaacaaagaagaat

SEQ ID NO: 424909 - DNA, 2663 bp, Homo sapiens
tccaggggaaaccggcctgggtggagagacagagaaggggagaccgggtgggtgggtcgtacgcttagggggccgtggttggtacttcgctgttggggaggctttcaggtcgcccagatcctgcttcccaatgggtgactgggaaaattagcgggtggaaaatctcgaggggtggaggctttttttttcctccttggccccgccctcttcctgttcggcgactgggacgcctggccctacgagggggaagggaggcttggccgggctatcggagagcgctgtgcgcacgcgcgagcccgagtgcgtgtgtgtgtgtgcacgcgcacgcgcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtgaattacactattgtactggagcttatcggatttcacctgtagatgtaaatagtagaccttcctcctgccttactaattttcttctaaatgaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaacaaagaagaat

SEQ ID NO: 424910 - DNA, 1247 bp, Homo sapiens
ccatgttcctaggatgcccgtcattcatgccgttcttagagctacatgatgacgtccttgcgttcagcgccctcgctgtcgtattcccctcgcgtatggccctcggtgcgtgatatccatcgcctcggcgtcactgggtctatcccatgcatctcagcaccctatccatgatgtcccgcactgtcccccactgcaggcgtgatgattccgcctccggcctacttccacaattcgctacgaggatcattttctctctccatatccaactagttgcatatcctttctcacacttacacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaacaaagaagaat

SEQ ID NO: 424911 - DNA, 2978 bp, Homo sapiens
tccaggggaaaccggcctgggtggagagacagagaaggggagaccgggtgggtgggtcgtacgcttagggggccgtggttggtacttcgctgttggggaggctttcaggtcgcccagatcctgcttcccaatgggtgactgggaaaattagcgggtggaaaatctcgaggggtggaggctttttttttcctccttggccccgccctcttcctgttcggcgactgggacgcctggccctacgagggggaagggaggcttggccgggctatcggagagcgctgtgcgcacgcgcgagcccgagtgcgtgtgtgtgtgtgcacgcgcacgcgcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaacaaagaagaat

SEQ ID NO: 424912 - DNA, 2722 bp, Homo sapiens
tccaggggaaaccggcctgggtggagagacagagaaggggagaccgggtgggtgggtcgtacgcttagggggccgtggttggtacttcgctgttggggaggctttcaggtcgcccagatcctgcttcccaatgggtgactgggaaaattagcgggtggaaaatctcgaggggtggaggctttttttttcctccttggccccgccctcttcctgttcggcgactgggacgcctggccctacgagggggaagggaggcttggccgggctatcggagagcgctgtgcgcacgcgcgagcccgagtgcgtgtgtgtgtgtgcacgcgcacgcgcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaacaaagaagaat

SEQ ID NO: 424913 - DNA, 1320 bp, Homo sapiens
  misc_feature (509)..(509): n is a, c, g, or t
ccatgttcctaggatgcccgtcattcatgccgttcttagagctacatgatgacgtccttgcgttcagcgccctcgctgtcgtattcccctcgcgtatggccctcggtgcgtgatatccatcgcctcggcgtcactgggtctatcccatgcatctcagcaccctatccatgatgtcccgcactgtcccccactgcaggcgtgatgattccgcctccggcctacttccacaattcgctacgaggatcattttctctctccatatccaactagttgcatatcctttctcacacttacacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgatctttcactgctttctctgacttgtcctctttgtcttccctntttcttcctcgtttctttcgttcttcctcttctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaacaaagaagaat

SEQ ID NO: 424914 - DNA, 2232 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttcaaaaaaaaa

SEQ ID NO: 424915 - DNA, 2971 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcggtaggtccaggggacgccggtggagtggcggggggaggaggacagggagggccctggccagggatagccaggctagtgttggaggcactgccacctctccatggacgatggatgacctctggcaagtgtcttcctttcttggggcctcagctgtttcatccgcaaatggggatgttccacctgaccccacccacatctgcaggtggtgagagcagatggaatggcactttgcaaatccccaccagctggtaaaggtgatagcctcactcttctgcttaaagccgtcagtggctgctcatcacactagaataaaatggaaactcctcaccataggatccagcctctgcccacctctctgacagcatctccctgcgattctccaccccacaccttgctccagccacactgacctcaccaaccctgtccctgtctcaggccgattcctcattgctctcaggccactccccagggatgccttcctcagcctcaccctggctgaagtggaccccagcctgcacctccagcccagcaccctctgtcgcatcctcctgtgctatgtgtgatgttctgcttttgtctttgtactcactccagactcaggactgcaagagggcagggcctgggctttcctgtgcatcctcatgtccccaaaccagtggttccccaagtgtggtcctgggagcctggctggggtcccaggggcacccctgagcacctccctgctctccttgcctttcagctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttcaaaaaaaaa

SEQ ID NO: 424916 - DNA, 2178 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaggcttgtggtcaagcaaattcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttcaaaaaaaaa

SEQ ID NO: 424917 - DNA, 2049 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaaaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcagcaacaagcttcaaaaaaaaa

SEQ ID NO: 424918 - DNA, 2607 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgga

SEQ ID NO: 424919 - DNA, 2902 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggagtctgcgtgtgtcagtgatgcctagccccgccttccccagcagaccaatgtagggatggaaaagggagaaaaacagtaaacttgtgaccctgaggttcttgtctccagcgtccaccctgcggcttgggagctcctcctggggaggcagcccccgtacatacgcacccgcgactttgcagctttcacctgaaggtctgagcgaagcccgggcggcgcacgtgcagtggatacctccacccccctgggaggcggggtcgcgctcagagccaatgagagcttgcggggtggaggggta

SEQ ID NO: 424920 - DNA, 2994 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggtaggtcctaggaggtaggtagaagatagtctgagcaggtggtggcacctaagctatctgatctccaagggagcaagtggtgctgctttgggcagggagcatctcacagaaatggagaaaagattattgctctttttcacagatttctaccccattatatgtaagttttatggatctttaatccataatctttctgcactcaatcctctgctctgggtctctacttccttcagggctgtcacaaacctgggctggtgtatccaagacttagatcttcctcatgatacggaatacttaacattttactgccttgtgccaggcactgtgcttggtgcttttcatgcattatcaaaatataattgttactacagccctgtgagagtagctaattttattaattgcattttccagatgagaacactgaagcattatagatcaaataatttgcttaaggccatgaaacttgtaagtggtagggtcagaatttgaatccaggcagtctgactccaaagtcttgccactaaccacactgcaatactgtctctaaatgggaagcatgtgtctgaggccctgggatccctcagatggctaccgtgactctctagcacctagagtaacaccaaggaagcctcttgtagcctcaagccctcctttgttgctgctggtcttaagtggctggttgcatttcatcttctgggaaatgctctggcaacctccccacagtcctatgccttttctctagggtggaaaccacccatttcccagttgagatcatttttccagtaggcatcttacattctaagaactatgaaaatagttttcctgaaaaagacaagggaagcagcagcagcattctcctttccccacacccatatacacgcctgtgccctgtaactgaagtgtgagaggcacagtgtcataaatgggtagatagtaagtggggactaaaactgtcaagggtgatctaattggggtgggctcatagtagtacttctgtgtgaatgctttggtggacccttaaggtactacatggaccagcctgggcaacatgatgagaccctgtctctacagatta

SEQ ID NO: 424921 - DNA, 2547 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgga

SEQ ID NO: 424922 - DNA, 2499 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgga

SEQ ID NO: 424923 - DNA, 770 bp, Homo sapiens
agtgacgagcagggaagaggtggatgtccgaagagaagaccttgtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgga

SEQ ID NO: 424924 - DNA, 1535 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgtatctttctaaacttgggctcttgagactttggatggattggcactcacttggctcaggtttaagaatggtagagtaggtaggatcaaatatgaggcctttggcgattaggggaattatttctctaaaccaggagtggaactttggctaaacagagcatacacatccttagaaatcttctgaatcctgagtgagacctcagcttgatgtcagggcccagttccaactctacagtcatcccctggctccagaatacctctcccctgccctgtccagtgaacaaaattcttcttaatggactagcaacacatttcccttgtctccaagctacacagagaatcatctgcttagaaatcccatatgggggcctttttctggtcgcctttttctggtctgtggccaacctgcccagcc

SEQ ID NO: 424925 - DNA, 1094 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggtcattgaggaggatctgaaatgctgcagaggagaggacagtcgctctgggcgctgggctggactggactctacctgagtcattctgggatggcaaagtgatggcagaaactaggccagctgggtgatcaggggagtcagcctgctgctgctactccttcgttcattcaataaatgtgtatttagcgct

SEQ ID NO: 424926 - DNA, 1986 bp, Homo sapiens
aaaaaaaaaaaaaaaaaaaaaaaaaaaaaaaaaaaaaaatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgga

SEQ ID NO: 424927 - DNA, 2650 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggaaaaaaaaaaaaaaaaaaaaaaaaaaaaaaaaaaaaaaaaaaaa

SEQ ID NO: 424928 - DNA, 2761 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtcagagctgacaaggctgggagggcaaagttgggcctggcctctcacaagagaagatccttgtgcagagggaccagtagcctaagtgaccatgactattgcaggtcatgtaagaaaagagattcccccctcactatgcattggttccttgcaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgga

SEQ ID NO: 424929 - DNA, 2385 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgga

SEQ ID NO: 424930 - DNA, 1312 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgtgagtgttgggaaaccgtggggcaggatgagttacttggggctctctcaagccagcagaatcta

SEQ ID NO: 424931 - DNA, 1407 bp, Homo sapiens
atactcccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggtgaggaatgggcaagaagaaactacatggtagatgagtgggcatttgaataacaaagaagatgacaacaagagagtgagggtccaaagggcccactcctgttgtggacacagaccagtctttgctccaataagaagagggacaagaatggcttggagggagaggccctgtcttttattatcttggttgtggccagcagattccaaaagagagccattctttggaatggtaattgttctgggtcctctctacattgtattgcgtggcatctgtacttggaatgttttctagattcatgcaaaccatacgtacataaatatgcaaccactctcctattgaaaaaaaaaaaaaaaaaaaaaaaaaaaaaaaaaaaaaaaaaaaa

SEQ ID NO: 424932 - DNA, 2936 bp, Homo sapiens
ggcagatgacattctggggttactggagtccacctctgtgctgatggggaaagtatggcatgatgaatccaaagcaaccagtaattctttttgaaagtgcaggcatttattttgagctgtatttcataggagtttcatttggtttggttttggtatagagaggtgtccatagatctctattccctttttttttttatcgacaaggcctactacggataaatcagtttttgttgcctgaatacactttgaattagactacagaagccagtttgagctcaaatttcacacttgctgcagacaactctcagtgtggacagtgcctttctgagtaattaggatgttatatgactttttggtgaagccgtatagggtaaggagatgccccaaggcccctgatcatttcagaagccacctggagcaccagaaggggtcatcttcccagggctatggctctgtgtgcttagacatagtatggaattgtgctctaagcccacaggcttctccagagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccaggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagattttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcgtaagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaagaggggtgggaatgacttttcaatgtacaccttttgtaccttttgaattttgtaccatgtacatgtattatctattaaaaaatagttcttaattttta

SEQ ID NO: 424933 - DNA, 3039 bp, Homo sapiens
ggcagatgacattctggggttactggagtccacctctgtgctgatggggaaagtatggcatgatgaatccaaagcaaccagtaattctttttgaaagtgcaggcatttattttgagctgtatttcataggagtttcatttggtttggttttggtatagagaggtgtccatagatctctattccctttttttttttatcgacaaggcctactacggataaatcagtttttgttgcctgaatacactttgaattagactacagaagccagtttgagctcaaatttcacacttgctgcagacaactctcagtgtggacagtgcctttctgagtaattaggatgttatatgactttttggtgaagccgtatagggtaaggagatgccccaaggcccctgatcatttcagaagccacctggagcaccagaaggggtcatcttcccagggctatggctctgtgtgcttagacatagtatggaattgtgctctaagcccacaggcttctccagagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccaggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagattttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcgtaagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaagaggggtgggaatgacttttcaatgtacaccttttgtaccttttgaattttgtaccatgtacatgtattatctattaaaaaatagttcttaatttttaatttggtatacttttcttaatagaaccaaaatggaagaaaattctgattctctaaatctgctttcttaaagataaagcctttgattcaaaagtagtgagactc

SEQ ID NO: 424934 - DNA, 2702 bp, Homo sapiens
  misc_feature (29)..(29): n is a, c, g, or t
agaatgatgtatgatgtgcgataccgggntgtgtatttcagtgacgaggggccggcgcttcagctgtatatctagatgtgtcttctgtggactctatcaagtgatgttatatgactttttggtgaagccgtatagggtaaggagatgccccaaggcccctgatcatttcagaagccacctggagcaccagaaggggtcatcttcccagggctatggctctgtgtgcttagacatagtatggaattgtgctctaagcccacaggcttctccagagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccaggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagattttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcgtaagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaagaggggtgggaatgacttttcaatgtacaccttttgtaccttttgaattttgtaccatgtacatgtattatctattaaaaaatagttcttaattttta

SEQ ID NO: 424935 - DNA, 1047 bp, Homo sapiens
taaattacagtatgactatccagtagactgttgtgccatcattataatttatgtttctgaagaatatttgacagcatggcaaagtgcttatagtgttaagtgaaaagagtgatatacaaaattgtatgtataaatccaaaaaatgacttttaaaaagatggaaaggatatgcaaactctgggtagttggattatgggttttcctggttttatgctttaaaaaattttctccagtatattactacttatattatcagtaaaaatcaatagcatctagagctggcagtggagagattgaggccagatcactagtttggtccatgaacaattaactggctgggtggacacagaggctatatgatcttgtgttggcagcaaggctgggacagaagggaaaaggacctgcccaggaggagaagggaccgtgtgactatgtgaccataatccctacaaaaaaacacaaagtgttaagggaagacactgtgggtggcatgctcttgtgatgtagtcgtaggtcggtaaaagaccacttatgaatcaagtatattctgacaagtggaaaaggatatgaatgctctcctgggtaaaattaacctcctttgcatttcattctcacattctcgcacaaaatgaattatcaagatggattttataatagctgattctctgaagaatccctgagactttgtatgattctttagtatagcagtggctttcgatgtgccaagtctacctcctcccatactgggacactcaagcaacacagatgtacacgggaattttgggtattctatactgagaatactgcacacatatcgttagtcatcttaatgttgtaacttaccaaactcttaaggtttgcaaatgtgattttgttggcatctagaaccagtgtattttttatttatgtctgaaaaataatcattgtggggttttaaaatgaaaaatcatgtagctaatgcctatccatagatgaaattgttatgttgggaaaatgtgtacttaatctttgctttagtaaaatgattattataaaaatgttaaaggt

SEQ ID NO: 424936 - DNA, 471 bp, Homo sapiens
ccctgtgatctgcaaggctccctgcaggaaggcaccgttttagaggcacactctattatgactgattagacgacccttctcggggcctgcctgagaacaaaagttctgttttcttttcagggccttgtgaagtaaacagttatttcatagttagtcctaggtgaaaaccatcttttaccatctactgagtgcaccagcagtctgagggctatatgagggccataatggcctgacaaaaccacttttctggggtgttctgtggctgtcaatggtctgttattgttgtctcttgaagtgattggacatttcatacacatacaccatgcagcagccatgacagaagcagatcactccaacctgctgctggctctcatgtctccttgggatttaactgtgaatatgttcatccagctgaaatgctctgaaactgaacaaccttatctcactccgctaaaacaaaaactaatgaaa

SEQ ID NO: 424937 - DNA, 1772 bp, Homo sapiens
ctgggaagacgctggtcagttcacctgccccactggttgttttttaaacaaattctgatacaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaacgcagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgcttaagccttcacatg

SEQ ID NO: 424938 - DNA, 1845 bp, Homo sapiens
cttcctggggagcaggaagggtcagggaaggaaaagaagtacagaagatctggctaaacaatttctgtatggcgaaagaaaaattctaacttgtacgccctcttcatgcatctttaattcaatttgaatattccaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaacgcagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgcttaagccttcacatg

SEQ ID NO: 424939 - DNA, 3216 bp, Homo sapiens
  misc_feature (3209)..(3209): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424940 - DNA, 1786 bp, Homo sapiens
  misc_feature (1584)..(1584): n is a, c, g, or t
  misc_feature (1622)..(1622): n is a, c, g, or t
  misc_feature (1771)..(1771): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactgtaagtgactcctcaccccttcctatatgtccctctaggattactctgtcaatggtgtgcaaaatggataaaactcacaggaggcagaatatcaatgaagagaccattatagcaaacagaattgcaaagtggttaagagctcagctcaggccgggcacagtggctcacgcctgtgatcccagcagtttgggaggccaaggcgggcggatcacgagggcaggagatcgagnccatcctggctaatatggtgaaaccccgtgtctactanaaatacaaaaaaaaattagccgggcatggtggcgggcgcctgtggtcccagctactcgggaggctgaggcgggagaatggcgtgaacctgggaggcggagctttcagtgagccgagatggtgccactgcactccagtctgggcaacagngcaagactctgtctc

SEQ ID NO: 424941 - DNA, 1800 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactggtaagtaattcctggagcatcaacactaagatctggggtacaagctttctggttttcaaataggagcagagaagaaattttcttttgcagcctgtatccaacaggcacaaacaagtccaaattctcccctgaaccctctcaattcatctgtgcagactctcttccctttgtttttctgatttctcacagctgaccttaggtccagcctggaatgtggggagggggttctctcagccccagaaagccccgtgtagcaggaggggcttcacagagggggaagcagaaagggtcctcaaggtcaatttgcttctgtcactaacatgtccctttctgtaacttcttggccttcttttacctattccatgagatataaggaatatgtgaggttttaaaacagactcacaatagttttccctaaatgagagaaggaaatgcccttcatcagggatgagcagctcagactctgctccctgctctactcccggcttgcccggtgattggctctgccctgaccccatgtggggtaggacgcaggtgtgtgcagaaggtgtccaggtggcctgtcatgaatccagctaaatcaagatggcagtcaatggctgggcgctgtggttcatgcctgtgatcccagtactttggaaggccgaggtgagaggatcacctgaggtcaggagttcgagaccagcctgaccaacatggcaaaactccatctctactaaaaatacaaaaaaaaa

SEQ ID NO: 424942 - DNA, 1652 bp, Homo sapiens
  misc_feature (1450)..(1450): n is a, c, g, or t
  misc_feature (1488)..(1488): n is a, c, g, or t
  misc_feature (1637)..(1637): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactgtaagtgactcctcaccccttcctatatgtccctctaggattactctgtcaatggtgtgcaaaatggataaaactcacaggaggcagaatatcaatgaagagaccattatagcaaacagaattgcaaagtggttaagagctcagctcaggccgggcacagtggctcacgcctgtgatcccagcagtttgggaggccaaggcgggcggatcacgagggcaggagatcgagnccatcctggctaatatggtgaaaccccgtgtctactanaaatacaaaaaaaaattagccgggcatggtggcgggcgcctgtggtcccagctactcgggaggctgaggcgggagaatggcgtgaacctgggaggcggagctttcagtgagccgagatggtgccactgcactccagtctgggcaacagngcaagactctgtctc

SEQ ID NO: 424943 - DNA, 738 bp, Homo sapiens
aattgtgagctttcaccttaagtccatttcaggtacatgcatattctactgacgcatattttgttcaatcgatactgtagcatttgcacccgggctgaccaccgagtatccacacagtgctacttgcattgtcaccagctgagtgactgtgagggtagccccaattgtgcaacggtataacaagaatagctaggcacagtgctaacacctgtatcccacatatgggagccgaggctgaggatctctgagcccaggactccaagaccagcctgggcaaaatagtggaacccctatctctccaaaaataatttttttttaataagccaggtgggtggggatggtggctcacgcctgtaatcccaaattgctgggattacagtcatacaccactgtacctggcctacagttataaatttctttcttgcacaagattcttaactactctgagcctcggattcctcaaccgaaaattgcactgtgaatgcctgctccatagtattgcacgggtttggggtttttgttttgtttttgagcctgggtgatagagtgagaacctgcctcaaaaaaaaaaaaaaaaaaaaagaagaagaagaaatagatgcaaaaggtattatttatatattatatatatatatatatatatatatggagggagaagcattatacaagaaacccactgggacatggctatgatcaaatatgggaaagggggaaaaaaggaggtaaagcaaagtctca

SEQ ID NO: 424944 - DNA, 375 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaacccacacaaccaacttcagcctccccatccctaacagccacagaaataatttattcagaagtaaaaaagcagtaatgaaacctg

SEQ ID NO: 424945 - DNA, 435 bp, Homo sapiens
tgggccggcactacttggactctggcatacctggaacttctggcatagctggaccttctggcattcttggccttcttttacctattccatgagatataaggaatatgtgaggttttaaaacagactcacaatagttttccctaaatgagagaaggaaatgcccttcatcagggatgagcagctcagactctgctccctgctctactcccggcttgcccggtgattggctctgccctgaccccatgtggggtaggacgcaggtgtgtgcagaaggtgtccaggtggcctgtcatgaatccagctaaatcaagatggcagtcaatggctggtctcaaactcctgacctcaggtgatccacccacctcggcctcccaaagtacagggattacaggcatgagccaccatgcccagccttaatttttatatttttagtag

SEQ ID NO: 424946 - DNA, 325 bp, Homo sapiens
tctggtactaacatgctgggtctggaccatacactctgagggaagtaaattccttaactgatccttaaactccccaccctccaactgccacctccttcagctagaatcacctgaagtcagctttgcatttccatggatcgctaactcttcttttgcttctccagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctg

SEQ ID NO: 424947 - DNA, 4225 bp, Homo sapiens
  misc_feature (4218)..(4218): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424948 - DNA, 3309 bp, Homo sapiens
  misc_feature (3302)..(3302): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagagacagaatctcaccatgttgcccaggctggactcgaactcctgggctcaagcaatcctcccatctgtttcccaaagtgctgagattacagataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424949 - DNA, 3495 bp, Homo sapiens
  misc_feature (3488)..(3488): n is a, c, g, or t
attgtgaggtgatctagaggtcccgcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagatggcgtttcaccatgttgccaaggctggtctcaaactcctgagctcaagcaatccacccgcctccacctcccaaagtgctaagattacagataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424950 - DNA, 2623 bp, Homo sapiens
  misc_feature (2616)..(2616): n is a, c, g, or t
cagtggctcacacctgtaatcctgacactttgagaggccgaggtgggcacatcactgatgtcaggagattgagaccagcctggccaacatagtgaaaccttgttctactaaaaatacaaaaaattagccgggcgtggtagtggatgcctgtaatcccagctacttgggaggctgagacaggagcatcgcttgaacccgggaggcagagcttgcagtgagccgagatcgtgccattgcactccagcctgggcgacagagcgagactccgtcgcaaaaaaaaaaaactctaccagtcacttccctccaaagaggagtaaccactatcctgacttctaatgctccagattagtattgcttggttttgttcctatctaaaggagaaataaaacatatccttatatgtggcttcttcaacattgctttgtgagactcatccatattgtatgtatttgtggtttgctggttctcattgctgcattatcctatcccattgcatatataccataatttctctcttctaatgatcattcatcaggaggtcagcaagcagagaatgggtaacaacaaaagcccttctccagagctaaaatttcaaaatggtaacagcttgtggtgctgaatcacaccaggcaaggtgaggccctgccctgtgtcactgacttaactgatcattatttgtgcttttcagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424951 - DNA, 3931 bp, Homo sapiens
  misc_feature (3924)..(3924): n is a, c, g, or t
aggtcatgaagactggatggggcatcatcattccctaaaaaattatttaatgaaaaaaaacactaccttcccttttgtatgtaaagtgacagtcacaggaaggatgcctgatcacagctccaggaaagggtcagtgggaggccaggcacagtggctcacgcctgtaatcccagcactttgggaggctgaggcgggtggatcatgaggtcaggagatcaagaccatcctggctaacatggtgaaaccccgtctctactaaaaatacaaaaaattagctgggcatggtggcacatgcctttagtcccagctactcgggaggctgaggcaggagaatggcttgaacccgggaggcagagcttgcagtgagctgagatcatgccactgcattccggcctgggtgacagagcgagactccgtctgaaaaaaaaaaaaaaaaagtcagtgggaaaaacattctacctgatgatgaggttgctcggtctgtgcgctgagaagaagattccaagtggagatatagagatatccagagggtcactctgagacgatctggggtcaggagggaggtgcagccctctccttacaattcatcacctgaacaaagacactcgaccttctgcagagggtcagggctatcccctggttggtgacctttgcacagctcactgtgggacctgagagctggctaaaatctcagggaaaggagcatagccctaggccccaggccccaaccctattctcagtaggttatctcagatactctgcttgtccacagagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424952 - DNA, 3653 bp, Homo sapiens
  misc_feature (3646)..(3646): n is a, c, g, or t
aattgtgagctttcaccttaagtccatttcaggtacatgcatattctactgacgcatattttgttcaatcgatactgtagcatttgcacccgggctgaccaccgagtatccacacagtgctacttgcattgtcaccagctgagtgactgtgagggtagccccaattgtgcaacggtataacaagaatagctaggcacagtgctaacacctgtatcccacatatgggagccgaggctgaggatctctgagcccaggactccaagaccagcctgggcaaaatagtggaacccctatctctccaaaaataatttttttttaataagccaggtgggtggggatggtggctcacgcctgtaatcccaaattgctgggattacagtcatacaccactgtacctggcctacagttataaatttctttcttgcacaagattcttaactactctgagcctcggattcctcaaccgaaaattgcactgtgaatgcctgctccatagtattgcacgggtttggggtttttgttttgtttttgagacagggtgtcactctgtcacccagactggagtgcagtggtgcaaacacagctcactgcagcctcaacctcctgggctcaagcaattccctcaccttagcctcctaagtagtacatactaccacatctggctaatttatttttatttttgttttcagagagacagaatctcaccatgttgcccaggctggactcgaactcctgggctcaagcaatcctcccatctgtttcccaaagtgctgagattacagataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424953 - DNA, 2879 bp, Homo sapiens
  misc_feature (2872)..(2872): n is a, c, g, or t
aattgtgagctttcaccttaagtccatttcaggtacatgcatattctactgacgcatattttgttcaatcgatactgtagcatttgcacccgggctgaccaccgagtatccacacagtgctacttgcattgtcaccagctgagtgactgtgagggtagccccaattgtgcaacggtataacaagaatagctaggcacagtgctaacacctgtatcccacatatgggagccgaggctgaggatctctgagcccaggactccaagaccagcctgggcaaaatagtggaacccctatctctccaaaaataatttttttttaataagccaggtgggtggggatggtggctcacgcctgtaatcccaaattgctgggattacagtcatacaccactgtacctggcctacagttataaatttctttcttgcacaagattcttaactactctgagcctcggattcctcaaccgaaaattgcactgtgaatgcctgctccatagtattgcacgggtttggggtttttgttttgtttttgagacagggtgtcactctgtcacccagactggagtgcagtggtgcaaacacagctcactgcagcctcaacctcctgggctcaagcaattccctcaccttagcctcctaagtagtacatactaccacatctggctaatttatttttatttttgttttcagagagacagaatctcaccatgttgcccaggctggactcgaactcctgggctcaagcaatcctcccatctgtttcccaaagtgctgagattacagataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424954 - DNA, 2549 bp, Homo sapiens
  misc_feature (2542)..(2542): n is a, c, g, or t
tgcatcaacgcgttgagactctccatattgtcgactgcaggcggcgcgaattcactagtgattagatgactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacagtaagtaaagccacttaccccagtgagaactggtatgttccaccacgtgccctcccctggcagggaatcctggattcccaaaccactccctcccttctgaattttcacagaaaggatctctatttcccaaccctaaggtggcataggtcttcccacccttcctagccacaggagtcccctgagacacatctgaggagagaggctcactctgcctaggccaggcaggcctgaggaagatcccatgtttccaggagccatttcctcagccttactccttccgcctcctgcctctattacggatgtgggcactctcccttgctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424955 - DNA, 2131 bp, Homo sapiens
  misc_feature (2124)..(2124): n is a, c, g, or t
tctggtactaacatgctgggtctggaccatacactctgagggaagtaaattccttaactgatccttaaactccccaccctccaactgccacctccttcagctagaatcacctgaagtcagctttgcatttccatggatcgctaactcttcttttgcttctccagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424956 - DNA, 1478 bp, Homo sapiens
  misc_feature (1471)..(1471): n is a, c, g, or t
ccccgtccccgatggcccaatgtacttaaatggaaaaaggacatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424957 - DNA, 1698 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctg

SEQ ID NO: 424958 - DNA, 876 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacaccccaccatttccccttcagacacttgcatccagagggtaccgagctgactta

SEQ ID NO: 424959 - DNA, 958 bp, Homo sapiens
aattgtgagctttcaccttaagtccatttcaggtacatgcatattctactgacgcatattttgttcaatcgatactgtagcatttgcacccgggctgaccaccgagtatccacacagtgctacttgcattgtcaccagctgagtgactgtgagggtagccccaattgtgcaacggtataacaagaatagctaggcacagtgctaacacctgtatcccacatatgggagccgaggctgaggatctctgagcccaggactccaagaccagcctgggcaaaatagtggaacccctatctctccaaaaataatttttttttaataagccaggtgggtggggatggtggctcacgcctgtaatcccaaattgctgggattacagtcatacaccactgtacctggcctacagttataaatttctttcttgcacaagattcttaactactctgagcctcggattcctcaaccgaaaattgcactgtgaatgcctgctccatagtattgcacgggtttggggtttttgttttgtttttgagacagggtgtcactctgtcacccagactggagtgcagtggtgcaaacacagctcactgcagcctcaacctcctgggctcaagcaattccctcaccttagcctcctaagtagtacatactaccacatctggctaatttatttttatttttgttttcagagagacagaatctcaccatgttgcccaggctacaatgagccatgattgtgccactgcactccagcctgggtgatagagtgagaacctgcctcaaaaaaaaaaaaaaaaaaaaagaagaagaagaaatagatgcaaaaggtattatttatatattatatatatatatatatatatatatggagggagaagcattatacaagaaacccactgggacatggctatgatcaaatatgggaaagggggaaaaaaggaggtaaagcaaagtctca

SEQ ID NO: 424960 - DNA, 692 bp, Homo sapiens
tgatccagaacgtcacccagaatgacacaggattctacaccctacaagtcataaagtcagatcttgtgaatgaagaagcaactggacagttccatgtataccgtgagtatttccccatgacctctgggtgttggggggttagttctacttcccacacatgggattgtcaggcctgggctgtgcctgtgtcctcctctgcattataccccatgttaaggtttgagcatctagtgcaggacacactatgggacagacatcaaaataccgaatgtcttactctggagtcctgatcctgcagacatttgcttcagaggaaggacaatctgatgtgggtaacttatcgaggggagaccagtctcaatctagccccccgggaccctcctggtgaacatgtccctaagaaagacccagtaggactcagtcagggtctggcctgaagggccttctgggatcctcacagacaagctcagccctgggaatcccctgctccaaaacactatcccaaggttctcaactcctggtgaccctgaggagcctgggccagggctagattgtggcctcctgggcagggctgactaggaacaagaatttgagctatccgagggctgtggctcctggagctggtaaccagccagggttcaggcactagagcctcatttgggcaaggatggagcctcatccttcaccttagt

SEQ ID NO: 424961 - DNA, 428 bp, Homo sapiens
aactactctgagcctcggattcctcaaccgaaaattgcactgtgaatgcctgctccatagtattgcacgggtttggggtttttgttttgtttttgagacagggtgtcactctgtcacccagactggagtgcagtggtgcaaacacagctcactgcagcctcaacctcctgggctcaagcaattccctcaccttagcctcctaagtagtacatactaccacatctggctaatttatttttatttttgttttcagagagacagaatctcaccatgttgcccaggctggactcgaactcctgggctcaagcaatcctcccatctgtttcccaaagtgctgagattacaggtgtgagccaccacgcctggccccatagtgttattttaaagatttaatgtaataataaaccttcagcaaaacaccacacaca

SEQ ID NO: 424962 - DNA, 3504 bp, Homo sapiens
  misc_feature (3497)..(3497): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424963 - DNA, 1645 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctg

SEQ ID NO: 424964 - DNA, 1503 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagagacagaatctcaccatgttgcccaggctggactcgaactcctgggctcaagcaatcctcccatctgtttcccaaagtgctgagattacagataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctg

SEQ ID NO: 424965 - DNA, 876 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtataccataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctg

SEQ ID NO: 424966 - DNA, 3451 bp, Homo sapiens
  misc_feature (3444)..(3444): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424967 - DNA, 3256 bp, Homo sapiens
  misc_feature (3249)..(3249): n is a, c, g, or t
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagatggcgtttcaccatgttgccaaggctggtctcaaactcctgagctcaagcaatccacccgcctccacctcccaaagtgctaagattacagataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424968 - DNA, 3811 bp, Homo sapiens
  misc_feature (3804)..(3804): n is a, c, g, or t
aatataaaagaatatatagagccaggcacagtggctcacgcctgtaatcccagcactttgggaggctgaggcgggtggatcatgaggtcaggagatcaagaccatcctggctaacatggtgaaaccccgtctctactaaaaatacaaaaaattagctgggcatggtggcacatgcctttagtcccagctactcgggaggctgaggcaggagaatggcttgaacccgggaggcagagcttgcagtgagctgagatcatgccactgcattccggcctgggtgacagagcgagactccgtctgaaaaaaaaaaaaaaaaagtcagtgggaaaaacattctacctgatgatgaggttgctcggtctgtgcgctgagaagaagattccaagtggagatatagagatatccagagggtcactctgagacgatctggggtcaggagggaggtgcagccctctccttacaattcatcacctgaacaaagacactcgaccttctgcagagggtcagggctatcccctggttggtgacctttgcacagctcactgtgggacctgagagctggctaaaatctcagggaaaggagcatagccctaggccccaggccccaaccctattctcagtaggttatctcagatactctgcttgtccacagagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424969 - DNA, 2072 bp, Homo sapiens
  misc_feature (2065)..(2065): n is a, c, g, or t
gcaagagagagaaataaagagcatccaaataggaagagaagaaagcaaactatccttgtttgtagaggacatgatcctatgtcttgaaaaccccatagtctcagcccaaaagcttcttaagctgataaacaacttcagcaaagtcttgggatacaaaatcaatgtgcaaaaatcaccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcggtgatnaaaaaaa

SEQ ID NO: 424970 - DNA, 1851 bp, Homo sapiens
cagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacaccacaggagtcccctgagacacatctgaggagagaggctcactctgcctaggccaggcaggcctgaggaagatcccatgtttccaggagccatttcctcagccttactccttccgcctcctgcctctattacggatgtgggcactctcccttgctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctg

SEQ ID NO: 424971 - DNA, 293 bp, Homo sapiens
tgattataatttcacactaatttaaatgatgtttactttagtagaagcataaatatacaaaaggaattatttaattccaaactgttctttatagtaatgaccaactacatgatgacaagggtgagtttaaattctgggtgattacttattttcttgttgcaaacatattgaaaatctggaataaaatgcaagtcataatatttacgatcagacacggatgttactttggcaaattacacagggtttacttttctaaaggatagaaagggaagccagtacaatcaaatttgaag

SEQ ID NO: 424972 - DNA, 4322 bp, Homo sapiens
  misc_feature (1819)..(1819): n is a, c, g, or t
gcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcattaaaaaaaaaaaaaaaaaaaaaaaaaaagaccaagaaaaagcctattccctatattatttaaaacaaaatgatggtaaaatacagtcctgacttctcagatatgcaaggttctgaggattttcagctttataatttgagacttctgagctttctctcttttgtgttatgagnttcatcattctccttcctctgctcatcctcaccttcacttctctcctgtgtcaagttttagaaactgattatgtcctgccaaaaattggactttgggaatagagaaaagagatggaggttgtgcttcactgtttctcaaggacatcatagcaatatgttttgcttaatattccaaagatattttcacctacaatattaacagccctctctatgggtaaaatttggcataattttaagacctttctggttcagagcacaacatgagaacaacagtaccaatgtttattatagaatttactacaaatatgcaagtgctttggctactggttgtgtgttggaagtcagaatctactgaattaagtataacccttttgcttccagcagaaacaaaaaaatttatacacacacacacacacacacacacacacacacacacacaatggatgttttttcacagaataattagaaaaacagcttttaaaaaactcagaccaagtagaaccagaaagccacatgaattttcagggctttggttaggtttacctgaaagtgtaggtgaatataaaagctttatcaaagctttacaaaagcataacgcatggcaatatgatgcactgtttgcgggagtcctgcgagggcacattgttccgtgcagtaatttcaatgtgcctaagttcttgtgtcttcactaattatgtatcttgacattcacttgctttgttgtaaccctcagagtctgttcaactatgtcgatagtctgtagcatctccagatctgcagcttttagttatcttgggccacatgtaatttatgtagacataactgaagatcatcagtttgggatgagattattgggttacgttgaggctcaacaagaaaaaccataatctttcctaaagagacggaacaggaggcaaatacaattcatttccttctttagaaatgaattcccttacaccctatcacttctgttttggacctcaaattaatactaggcgacagaaagattaaattcatttcacaagacagttttgtgatataagttattttgtgtaaaattttttaacacaaaattaaattcgtgaaaaccctagtttctgtatagatgagtgttttcagttgtccttattgttttattaacataagaagtgggagagctctcactgttttctcatgtgtgggtatagtattgaagaagtgttgcaattgtccccctggtatttgggtgcagctttttgtgattcccacagtagccctcagaggtcccctgtgcttttgaattttacttgcgtgttgctgttttgcaccaccaggggacactcagtttccacagaggggtgctatgctctaccaaaatggtgcagattctttttcctgtcaggggtggactccaaaaagattttgtcctggattttacagctttaggtggatccagtattgggtttagatgagttgacagagccctttctgagatgaagctaatagccagattttcactgaaacaggaaaaataaaaatttcaaaaaaattaaaacaaaatggagttaaaaactaaatatgttgccagagacccaaagataggcagctctagcaacttggggggcatgcaagtatccatccagggagctgagttccacccatgcggcggaggtgggaagagaggattctgggaaggtcccggttggaatggccttttttctgcctcagccatattattcagtggaaattcagaaaagaccccaaaacatttgtagtgcctttccctttctccccacccccagttccttcttcagtagccttccttgctaattaacactggctctgcagggatatttaccttttctctgctggattcctgtggttttgaaagaattcaggtacttgctggttgccaaggaattcagattacctcacaggctgcacactgtccagaatctgccacagcagcaagtaggggggaagagacaccaacaagggggagaaaaccctttccagtgctcattgtcaccctccctggcaggcccttgctgtttgtgaagtttgagtcatttctggctctaaagacaagggatcaggctggtaatcccctcccagacggctctgtagggcgctgcctagtcactgcagcgctttggcagtctcccggctgcagctggttgacagcagatcagagagctcttgggcctcttgttctcttccataagatttttctgggtcaggccaggatgaaacccagtggctcctggcaaggctgcctgaggtgctgtctcttcattgtccaggcctctctgactcaaaatgcctacacctgttgaaggataactcatgtgccacagcgaggtcgaggctggccttctcttttcttggtacatttgtagtgaatgtttgtcagaaaatataactaccaaagaggatgttaagcttctacatctagaatgcctgtgactctgaccataagaagatattggtatcaaaaaaaagtttttaagaaaacagcaggaca

SEQ ID NO: 424973 - DNA, 579 bp, Homo sapiens
gcctgctgagcacaaggtctccctgtgaacttcttcctggccttcaggggtgcccgtctccttggtatgatcacatagaggatgcccagatcattagagggcctagtatgtcttggtgggaagaaacaaaacagcaaagggagtcctaggggaggaggtgggctccccatccttcttgttctggaagttcttcatccccttgtttctctggtctggtcttcagcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacgtgagtatatgggagctttgtggggctgagatcggggtccaaggcttttgatgaggatgtggcaacatagatggggcaggga

SEQ ID NO: 424974 - DNA, 4572 bp, Homo sapiens
  misc_feature (2069)..(2069): n is a, c, g, or t
gcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggtaaacgcctgcgcccgcgcgcttccctaccctagggaggagcattcccgggtccgggctggcgcctgcagcaggacttcccgctcagagcccgggagtagctgttggcttccgggcgcgccgcgttgaatcgcggctgcggggtcgtcccgtccttcccggggggagcatctgcggacctacgtgggattggggtgagctgggggtggggctgagaagcagattcctttcgggagaggagtctccttaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcattaaaaaaaaaaaaaaaaaaaaaaaaaaagaccaagaaaaagcctattccctatattatttaaaacaaaatgatggtaaaatacagtcctgacttctcagatatgcaaggttctgaggattttcagctttataatttgagacttctgagctttctctcttttgtgttatgagnttcatcattctccttcctctgctcatcctcaccttcacttctctcctgtgtcaagttttagaaactgattatgtcctgccaaaaattggactttgggaatagagaaaagagatggaggttgtgcttcactgtttctcaaggacatcatagcaatatgttttgcttaatattccaaagatattttcacctacaatattaacagccctctctatgggtaaaatttggcataattttaagacctttctggttcagagcacaacatgagaacaacagtaccaatgtttattatagaatttactacaaatatgcaagtgctttggctactggttgtgtgttggaagtcagaatctactgaattaagtataacccttttgcttccagcagaaacaaaaaaatttatacacacacacacacacacacacacacacacacacacacaatggatgttttttcacagaataattagaaaaacagcttttaaaaaactcagaccaagtagaaccagaaagccacatgaattttcagggctttggttaggtttacctgaaagtgtaggtgaatataaaagctttatcaaagctttacaaaagcataacgcatggcaatatgatgcactgtttgcgggagtcctgcgagggcacattgttccgtgcagtaatttcaatgtgcctaagttcttgtgtcttcactaattatgtatcttgacattcacttgctttgttgtaaccctcagagtctgttcaactatgtcgatagtctgtagcatctccagatctgcagcttttagttatcttgggccacatgtaatttatgtagacataactgaagatcatcagtttgggatgagattattgggttacgttgaggctcaacaagaaaaaccataatctttcctaaagagacggaacaggaggcaaatacaattcatttccttctttagaaatgaattcccttacaccctatcacttctgttttggacctcaaattaatactaggcgacagaaagattaaattcatttcacaagacagttttgtgatataagttattttgtgtaaaattttttaacacaaaattaaattcgtgaaaaccctagtttctgtatagatgagtgttttcagttgtccttattgttttattaacataagaagtgggagagctctcactgttttctcatgtgtgggtatagtattgaagaagtgttgcaattgtccccctggtatttgggtgcagctttttgtgattcccacagtagccctcagaggtcccctgtgcttttgaattttacttgcgtgttgctgttttgcaccaccaggggacactcagtttccacagaggggtgctatgctctaccaaaatggtgcagattctttttcctgtcaggggtggactccaaaaagattttgtcctggattttacagctttaggtggatccagtattgggtttagatgagttgacagagccctttctgagatgaagctaatagccagattttcactgaaacaggaaaaataaaaatttcaaaaaaattaaaacaaaatggagttaaaaactaaatatgttgccagagacccaaagataggcagctctagcaacttggggggcatgcaagtatccatccagggagctgagttccacccatgcggcggaggtgggaagagaggattctgggaaggtcccggttggaatggccttttttctgcctcagccatattattcagtggaaattcagaaaagaccccaaaacatttgtagtgcctttccctttctccccacccccagttccttcttcagtagccttccttgctaattaacactggctctgcagggatatttaccttttctctgctggattcctgtggttttgaaagaattcaggtacttgctggttgccaaggaattcagattacctcacaggctgcacactgtccagaatctgccacagcagcaagtaggggggaagagacaccaacaagggggagaaaaccctttccagtgctcattgtcaccctccctggcaggcccttgctgtttgtgaagtttgagtcatttctggctctaaagacaagggatcaggctggtaatcccctcccagacggctctgtagggcgctgcctagtcactgcagcgctttggcagtctcccggctgcagctggttgacagcagatcagagagctcttgggcctcttgttctcttccataagatttttctgggtcaggccaggatgaaacccagtggctcctggcaaggctgcctgaggtgctgtctcttcattgtccaggcctctctgactcaaaatgcctacacctgttgaaggataactcatgtgccacagcgaggtcgaggctggccttctcttttcttggtacatttgtagtgaatgtttgtcagaaaatataactaccaaagaggatgttaagcttctacatctagaatgcctgtgactctgaccataagaagatattggtatcaaaaaaaagtttttaagaaaacagcaggaca

SEQ ID NO: 424975 - DNA, 1062 bp, Homo sapiens
gcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgaca

SEQ ID NO: 424976 - DNA, 300 bp, Homo sapiens
ccttcccggggggagcatctgcggacctacgtgggattggggtgagctgggggtggggctgagaagcagattcctttcgggagaggagtctccttaggtgagtatctctactcttcttccgatagacctgtttctccccgctctgcaggcagcctaggagaggttggcatcccttcccgtttggaggttttgtttgtttaaacttaaagggcttcccagcattttgggaaagatcaagaaatcccgttgagaatcccctgaagaaagccattgaagttgttagacattgcctattgcgcc

SEQ ID NO: 424977 - DNA, 3624 bp, Homo sapiens
actctgcgggcgaagtggctgcgcaaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagtctctgtttcttctggaataggcaagcgtcctttcaactctaagagaccagcagaggccactgtcccttaagactgccggagtcctcaccacttctccaggattccagaggagactgtggcgatggtgaatgaaggtcccaaccaggaagagagcgatgacacccctgtgccggagtccgcactccaagcggaccccagcgtctcggtccatcccagcgtctcggtccatcccagcgtctccatcaaccccagcgtctctgtccaccccagcagttcggcccaccccagtgccttagcccaacccagtggcttggctcaccccagtagctcgggccctgaggacctcagcgtgatcaaggtgagcaggcgccgttgggccgtggtcctggtgtttagctgctactccatgtgcaactcctttcagtggatccagtacggctccatcaataacatcttcatgcacttctacggtgtcagtgcctttgccattgactggctgtccatgtgctacatgctgacttacatccctctgctcctgccagtggcttggctgctggagaagttcggcctgcgcaccattgctctcactggctcggctctcaactgcctgggggcctgggtgaagctgggcagcctgaagccgcatctctttccggtcaccgtggtgggccagctcatctgctctgtggcccaggttttcatcctgggcatgccctcccgcatcgcttccgtctggttcggggctaatgaggtttcaacagcctgctcggtggctgtctttggcaatcagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctcctccggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaaatgtttaccaaacctattgctttattttaaaaacataatttgtgttttctatttgtaagatctgacatttcgaggcaataaaaacttctcagaaa

SEQ ID NO: 424978 - DNA, 870 bp, Homo sapiens
gcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtaatgctctttgtagctgctttgcttcatttaaaggtacatgacattggggcatgtagccagcaaaggtaattagtgtccttaaagaagaggaagatgaaaatgaagaagaagaaggacttttttttttttttttgagatgagtatcgctctgtcacccaggctggagtgcagtggcatgatcttggctcactgcaacctctgcctcctgagttcaagcaattctcctgcctcagcctac

SEQ ID NO: 424979 - DNA, 5176 bp, Homo sapiens
  misc_feature (2673)..(2673): n is a, c, g, or t
actctgcgggcgaagtggctgcgcaaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagtctctgtttcttctggaataggcaagcgtcctttcaactctaagagaccagcagaggccactgtcccttaagactgccggagtcctcaccacttctccaggattccagaggagactgtggcgatggtgaatgaaggtcccaaccaggaagagagcgatgacacccctgtgccggagtccgcactccaagcggaccccagcgtctcggtccatcccagcgtctcggtccatcccagcgtctccatcaaccccagcgtctctgtccaccccagcagttcggcccaccccagtgccttagcccaacccagtggcttggctcaccccagtagctcgggccctgaggacctcagcgtgatcaaggtgagcaggcgccgttgggccgtggtcctggtgtttagctgctactccatgtgcaactcctttcagtggatccagtacggctccatcaataacatcttcatgcacttctacggtgtcagtgcctttgccattgactggctgtccatgtgctacatgctgacttacatccctctgctcctgccagtggcttggctgctggagaagttcggcctgcgcaccattgctctcactggctcggctctcaactgcctgggggcctgggtgaagctgggcagcctgaagccgcatctctttccggtcaccgtggtgggccagctcatctgctctgtggcccaggttttcatcctgggcatgccctcccgcatcgcttccgtctggttcggggctaatgaggtttcaacagcctgctcggtggctgtctttggcaatcaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcattaaaaaaaaaaaaaaaaaaaaaaaaaaagaccaagaaaaagcctattccctatattatttaaaacaaaatgatggtaaaatacagtcctgacttctcagatatgcaaggttctgaggattttcagctttataatttgagacttctgagctttctctcttttgtgttatgagnttcatcattctccttcctctgctcatcctcaccttcacttctctcctgtgtcaagttttagaaactgattatgtcctgccaaaaattggactttgggaatagagaaaagagatggaggttgtgcttcactgtttctcaaggacatcatagcaatatgttttgcttaatattccaaagatattttcacctacaatattaacagccctctctatgggtaaaatttggcataattttaagacctttctggttcagagcacaacatgagaacaacagtaccaatgtttattatagaatttactacaaatatgcaagtgctttggctactggttgtgtgttggaagtcagaatctactgaattaagtataacccttttgcttccagcagaaacaaaaaaatttatacacacacacacacacacacacacacacacacacacacaatggatgttttttcacagaataattagaaaaacagcttttaaaaaactcagaccaagtagaaccagaaagccacatgaattttcagggctttggttaggtttacctgaaagtgtaggtgaatataaaagctttatcaaagctttacaaaagcataacgcatggcaatatgatgcactgtttgcgggagtcctgcgagggcacattgttccgtgcagtaatttcaatgtgcctaagttcttgtgtcttcactaattatgtatcttgacattcacttgctttgttgtaaccctcagagtctgttcaactatgtcgatagtctgtagcatctccagatctgcagcttttagttatcttgggccacatgtaatttatgtagacataactgaagatcatcagtttgggatgagattattgggttacgttgaggctcaacaagaaaaaccataatctttcctaaagagacggaacaggaggcaaatacaattcatttccttctttagaaatgaattcccttacaccctatcacttctgttttggacctcaaattaatactaggcgacagaaagattaaattcatttcacaagacagttttgtgatataagttattttgtgtaaaattttttaacacaaaattaaattcgtgaaaaccctagtttctgtatagatgagtgttttcagttgtccttattgttttattaacataagaagtgggagagctctcactgttttctcatgtgtgggtatagtattgaagaagtgttgcaattgtccccctggtatttgggtgcagctttttgtgattcccacagtagccctcagaggtcccctgtgcttttgaattttacttgcgtgttgctgttttgcaccaccaggggacactcagtttccacagaggggtgctatgctctaccaaaatggtgcagattctttttcctgtcaggggtggactccaaaaagattttgtcctggattttacagctttaggtggatccagtattgggtttagatgagttgacagagccctttctgagatgaagctaatagccagattttcactgaaacaggaaaaataaaaatttcaaaaaaattaaaacaaaatggagttaaaaactaaatatgttgccagagacccaaagataggcagctctagcaacttggggggcatgcaagtatccatccagggagctgagttccacccatgcggcggaggtgggaagagaggattctgggaaggtcccggttggaatggccttttttctgcctcagccatattattcagtggaaattcagaaaagaccccaaaacatttgtagtgcctttccctttctccccacccccagttccttcttcagtagccttccttgctaattaacactggctctgcagggatatttaccttttctctgctggattcctgtggttttgaaagaattcaggtacttgctggttgccaaggaattcagattacctcacaggctgcacactgtccagaatctgccacagcagcaagtaggggggaagagacaccaacaagggggagaaaaccctttccagtgctcattgtcaccctccctggcaggcccttgctgtttgtgaagtttgagtcatttctggctctaaagacaagggatcaggctggtaatcccctcccagacggctctgtagggcgctgcctagtcactgcagcgctttggcagtctcccggctgcagctggttgacagcagatcagagagctcttgggcctcttgttctcttccataagatttttctgggtcaggccaggatgaaacccagtggctcctggcaaggctgcctgaggtgctgtctcttcattgtccaggcctctctgactcaaaatgcctacacctgttgaaggataactcatgtgccacagcgaggtcgaggctggccttctcttttcttggtacatttgtagtgaatgtttgtcagaaaatataactaccaaagaggatgttaagcttctacatctagaatgcctgtgactctgaccataagaagatattggtatcaaaaaaaagtttttaagaaaacagcaggaca

SEQ ID NO: 424980 - DNA, 557 bp, Homo sapiens
agcactgaacttggcaggaaaatcagtaggagtaagtggcggaggcatgggactggcagagatacggcagcccctgtggagaggctgtctacagataacataacaataaccacaggatctgcggggttcctgcatgcgtgttggcttcactggagaaactaatcaagtggtgcagtttggacacagagactgacacacaggaagaataccatgtgaagactggagttttgcatagagaagccaaggagctaccagaagctaggagaatggcctggaacagacctttccttagtgccttcagagagagcatggcgctgccaacatcttgatctcagacttccagcatcctgaattgtgagataaatttctgctgtttaaaccatataatttgtgatactttgctatggcaactgtcacagctattataagcacctaaccctttttttaatcttttaagaaactttttgctttcatctactttttttgttctggttattccatattttactttaagatttagtcttctgtcaataaagcaataatttcagatcaatttc

SEQ ID NO: 424981 - DNA, 777 bp, Homo sapiens
agcactgaacttggcaggaaaatcagtaggagtaagtggcggaggcatgggactggcagagatacggcagcccctgtggagaggctgtctacagataacataacaataaccacaggatctgcggggttcctgcatgcgtgttggcttcactggagaaactaatcaagtggtctgagtcattcaagttatagtctatttgaagacgagttgaatctgaaacaatgagtaagatgatgagagctcgatacttatggtttaaatataaaaggggtatcccaactcagaaagagagaggagatctggaaaaatcctgctttctgaagcttttgacggtattttcatactgcctgactaaagtgcaacagctacatattgacaggcggtggaaggtgcagtttggacacagagactgacacacaggaagaataccatgtgaagactggagttttgcatagagaagccaaggagctaccagaagctaggagaatggcctggaacagacctttccttagtgccttcagagagagcatggcgctgccaacatcttgatctcagacttccagcatcctgaattgtgagataaatttctgctgtttaaaccatataatttgtgatactttgctatggcaactgtcacagctattataagcacctaaccctttttttaatcttttaagaaactttttgctttcatctactttttttgttctggttattccatattttactttaagatttagtcttctgtcaataaagcaataatttcagatcaatttc

SEQ ID NO: 424982 - DNA, 666 bp, Homo sapiens
agcactgaacttggcaggaaaatcagtaggagtaagtggcggaggcatgggactggcagagatacggcagcccctgtggagaggctgtctacagataacataacaataaccacaggatctgcggggttcctgcatgcgtgttggcttcactggagaaactaatcaagtggtgcagtttggacacagagactgacacacaggaagaataccatgtgaagactggagttttgcatagagaagccaaggagctaccagaagctaggagaatggcctggaacagacctttccttagtgccttcagagagagcatggcgctgccaacatcttgatctcagacttccagcatcctgaattgccctgaaaaaatgggataatgcctacctacattggtgagagtgatgtttactcagtctactgaatcaaataccaatctcttctggaaatactatcagagacacaccaagaaacaacattttaccagcgatcggagcatcccttagcccagtcaaattgacccattaaataagccctcacactctgctataaggcatctgcactacacataaattgatattgttatatgaaggtaggcttatatttgttaaaaatgtacaaaatttacattatagatttgatggtaaataccaaaagatttaataaggaaac

SEQ ID NO: 424983 - DNA, 719 bp, Homo sapiens
tagtgagaaatgttttagatgatgataatgataatgttgggcaacccaatgagtatgacctgaacgacagctttctagatgatgaggaagaagactatgagccaacagatgaagattctgactgggaaccaggaaaggaagatgaagagaaggaagatggggaagagcttttgaaagaagcaaaaagagactcacattgacaatctaaggcttgtaaagaagcaccataacattacagaaacagacatgagatacgacgctgtagtgaagaacctccatattccatcaatccagattggaagaagacaaagaacacaagaccgaaactgaatccttgggtatgttctggaataaacctggattcctagggagaaaagagatccctgaaatgaaaattgccgtaaggagccctgaaaaaatgggataatgcctacctacattggtgagagtgatgtttactcagtctactgaatcaaataccaatctcttctggaaatactatcagagacacaccaagaaacaacattttaccagcgatcggagcatcccttagcccagtcaaattgacccattaaataagccctcacactctgctataaggcatctgcactacacataaattgatattgttatatgaaggtaggcttatatttgttaaaaatgtacaaaatttacattatagatttgatggtaaataccaaaagatttaataaggaaac

SEQ ID NO: 424984 - DNA, 1405 bp, Homo sapiens
ggtttatagtacaaaatcatcagttgcctgtcctaccctctcttctgccactttctagcccctaggggcaacacttaactcttccggccttttcttctggtgttttacctccctattttttgtaatacggtaatactgctatttataatttttcactttttgatgttatttattccttctaaggaagatagtgatttacttctcttatgccatacactctttccttctatgcatttttccagtgtatttatatcacaattataactttcttaaattatcttccaatatttacactattattactgtacagtgttcacagctaagccattagtatactataattgcatcctttcttttttttttttttttgagatggagtctcactctgttgcctaggctggagtgcagtggcgtgatctcggctcactgcaacctctgcctcccaggttcaagcaattctccggtctcagcctcccgagtcgctggaactacaggcacacaccaccacacttggctaattttttacatttttagtagagatggggtttcactgtgttagccaggatggtcttgatctcctgacctcgtgatccgcccaccttggcctcccaaagtgctgggattacaggcgtgagccaccacacctggcctcatttcctttctttatataaatttaaagacagaattttatggttctgacagagccatataacagaaccatcttaaacataccctctaaactgcccttcatcctcctgtttgaattctaacttgttttcagctgtcatcctagtactgcattcagcattatgctgggcattgccattgcttctctcttgtgttggcatccattttcctgcattttacaccgcctggtttcctagtttatttcttcattttggtggagcacatcattcaggagcttcctaagaaaggatgctgagagataagttggttgagatcttgtatatctgaaaatatctattctaccatcatatgtaattgataatttggcaggatatatcattctagcttgaaaaatcattttccctcagatttggaaggtttatcttcagtgttgctagtctccagtgttgttgagcaacccaaagacattctttagtcctttgtgacctttttttttttttttccccttgtgatagattttaggaccttctcttttcccccagtgttgtgaaattccacaggggtgtagcttgatggatctttttcattcattgtgtggcatactctgtgggcattttcattcaggaaatgtgtgtccttcagttctgaaaattttttcttatttattttaatgtttctcttcctgctttctggaacttctattagtttgatgctggatcttctgagttgatcctctgattctcttatctttctccta

SEQ ID NO: 424985 - DNA, 228 bp, Homo sapiens
acaaggtgtggcaggaaatccaggccagccaggaataccaggtcctaaaggggatccaggtcagacttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424986 - DNA, 1995 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424987 - DNA, 5319 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaacaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424988 - DNA, 5218 bp, Homo sapiens
cgccaagatggcaggggccggggcccagctgtcagtccgccgccgccgccgggtcgcccctggcccggcgcgcccgtccccggcagcgacaatgagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424989 - DNA, 5375 bp, Homo sapiens
cgccaagatggcaggggccggggcccagctgtcagtcgccgccgccgcggcccttccccgcagctagcggccccgacgcccacccggagaagatgagcccccgctgccccccgcagcccagtcagacgcggagccgccgcgcccggggccggctcccccgctagcgcccgcgtcccgcgccccgccgccgccgccgccgccgccgccgggtcgcccctggcccggcgcgcccgtccccggcagcgacaatgagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424990 - DNA, 5449 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggtgcgtgcatcctctaatgacaaagcaaccttgtatttccttccacaaatgaatggaggcagcctaacgtcatgtggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424991 - DNA, 5295 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagagagaaaagcagcctcccagtcagacaagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424992 - DNA, 4682 bp, Homo sapiens
cggcagcacatatactaaaattgggaacgatacagagaagattagcatggcccctgcgcaaggatgacacgcaaattcgtgaagcgttccatattttgcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424993 - DNA, 3562 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424994 - DNA, 3090 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424995 - DNA, 811 bp, Homo sapiens
  misc_feature (9)..(9): n is a, c, g, or t
  misc_feature (26)..(26): n is a, c, g, or t
tgttgctgnggtgactctagaggatncctttttgctttgcggagtggggtggggcaagcctctgtcgggagctggcattttcgttgacccggacgaggaggagtctgctctgcggagatcatggggacagcctcccaagctgaaggaagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424996 - DNA, 5532 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaccctcgggctcaggccctcgcattggtccatcacgctccgggctggggatgccccttttcagagaagggcccgggaccacggtgaccaggagtcgtaggagcaagatggcggtcttcgacaggaagctgggctcagaacattcccaagccccgggaagg

SEQ ID NO: 424997 - DNA, 5250 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacaagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 424998 - DNA, 2187 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaaaaaaactacaaaaaatctccgagggcatcctattgccggagcgcgcgcgacacaaccaggcacatgaacctggcgcccatttgcaagaggctggtccctggacccgagcttcctttgtccacagggtgcacgatctcccgggtctcccttatgggaagccgattaacttcagataagcagtgtacccggta

SEQ ID NO: 424999 - DNA, 3224 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
  misc_feature (3097)..(3097): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaaaaaaangaaaaaaaaaaaaggggggtttagtggggggggggaaaagaggagtaaagggccgggcatgggtttcggaccgttttgtaaagggggaaaggggggcccaaagggaggggaaaaagaaacgggaccg

SEQ ID NO: 425000 - DNA, 1246 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagagagaaaagcagcctcccagtcagacaagccagccacctaactcctcagaggctggccggaagccctgggagcgaagcagctccgtccccagcgctcatggtgttgaaactgtctgtcatgcaccacggtgtctgtgtccacacagtaataaacggtttactgtccgca

SEQ ID NO: 425001 - DNA, 2357 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtggacacaccaaagacagaaaaacagagaaaaaagaaaagagagaagaaacaaaaaaaggaaagggaaaaaagaaaggaagaaaaagaaaaagggaaaagaagaaacgacagaagaacagagaagagaaaggagaaagagaagaaagaagcgagacaagacaaagaaaaacaaagaaacagcagaaaacacagaggagcaaagagaagacaaaagcaagagaaaaaacagaccaaaaagaagaagaacacaaaacagagaggcacagaacacacaccagacaccaacaaacgagaagacgaagacaacgaacgagaaggaagacagcgagagaggcagcaaaggcgaagagagcaagaagaagacaaaaaaagagaggcgcagagagagggagaaggaggagacacgaagaccccaacgagagcgaagagacgaagagacagagaagaaaaggaaaaagaggcacaggcaagcaaaacagaaaaaagagaaggaaaagacaacaaaaaagaaaacagaagacgaaacagaaggagagacaaggagcaagagaagaacgagaagaaaggaagaagaacggagagacagcagagaggaggacaagacacaaaaacagaaaggagaagaagaagagaggggagggggaaggacagagacgagaggacgaatcaggaaagcacagaggaagagggccagagaacgaagcacgaaggcaggaggagcagggagagaagaggaagacacgagcaaggcacgaagaggaaagagaggcaggacaacacgaaggaggaggagaacgacagaaaaagacgagaagaagagcacgcacgacagacgcgccgagtgagagaagacgaggcgacgacagcagcaaagacagcgctcagaaagctgcgacaagggagacagcagagcagcacgagagagaggagaagaaacagcaagaggacggaacaaggagaggcgagagcagagaaaggccacaacgacaagaggaagacgagaaactgagagaggagaggaacagagaagggcacaagacgagcgaaaagcgagagagacagatgagcgccacgaacgagaggacgagagcgcgcggtgcgagcaggaaggagagagaggagaagcggagcggacgggcgaagcaaacagaccgggagagcagaacctgagaggacgacgagcgaagacgggagaggagcgaagagcacggcaacgaccagcagcggaaggaaagacagggagaagagcacagagacaaacgacgaaagaccgacagaagcagaacacgagaagcagacgaagcgcgaacaggagagagaaggacaagaagcagagccagcacagagcagacgcaagaaccaagagagagaagcagacacagcggaaagaacacaagagagaagaggaagaaaaagacgaaagacgaaagagaaacgaagagagagaaccacggacgaggaaggaccacacaacagcgtagggacacaacagcaatgaagcagcagcgacgacagagggcaaaagtccacgcaagtgcgcaggacagagcgcgacgagggaggacgacaca

SEQ ID NO: 425002 - DNA, 897 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
  misc_feature (790)..(792): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtggtnnntatggcattccgaagcatacacggtttgcagcacaaccggagtttcatgcaggacctgtcgctgacatgcctgtctcctgtcatatcagaccgttgggcagattt

SEQ ID NO: 425003 - DNA, 2202 bp, Homo sapiens
cgccaagatggcaggggccggggcccagctgtcagtccgccgccgccgccgggtcgcccctggcccggcgcgcccgtccccggcagcgacaatgagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtggacacaccaaagacagaaaaacagagaaaaaagaaaagagagaagaaacaaaaaaaggaaagggaaaaaagaaaggaagaaaaagaaaaagggaaaagaagaaacgacagaagaacagagaagagaaaggagaaagagaagaaagaagcgagacaagacaaagaaaaacaaagaaacagcagaaaacacagaggagcaaagagaagacaaaagcaagagaaaaaacagaccaaaaagaagaagaacacaaaacagagaggcacagaacacacaccagacaccaacaaacgagaagacgaagacaacgaacgagaaggaagacagcgagagaggcagcaaaggcgaagagagcaagaagaagacaaaaaaagagaggcgcagagagagggagaaggaggagacacgaagaccccaacgagagcgaagagacgaagagacagagaagaaaaggaaaaagaggcacaggcaagcaaaacagaaaaaagagaaggaaaagacaacaaaaaagaaaacagaagacgaaacagaaggagagacaaggagcaagagaagaacgagaagaaaggaagaagaacggagagacagcagagaggaggacaagacacaaaaacagaaaggagaagaagaagagaggggagggggaaggacagagacgagaggacgaatcaggaaagcacagaggaagagggccagagaacgaagcacgaaggcaggaggagcagggagagaagaggaagacacgagcaaggcacgaagaggaaagagaggcaggacaacacgaaggaggaggagaacgacagaaaaagacgagaagaagagcacgcacgacagacgcgccgagtgagagaagacgaggcgacgacagcagcaaagacagcgctcagaaagctgcgacaagggagacagcagagcagcacgagagagaggagaagaaacagcaagaggacggaacaaggagaggcgagagcagagaaaggccacaacgacaagaggaagacgagaaactgagagaggagaggaacagagaagggcacaagacgagcgaaaagcgagagagacagatgagcgccacgaacgagaggacgagagcgcgcggtgcgagcaggaaggagagagaggagaagcggagcggacgggcgaagcaaacagaccgggagagcagaacctgagaggacgacgagcgaagacgggagaggagcgaagagcacggcaacgaccagcagcggaaggaaagacagggagaagagcacagagacaaacgacgaaagaccgacagaagcagaacacgagaagcagacgaagcgcgaacaggagagagaaggacaagaagcagagccagcacagagcagacgcaagaaccaagagagagaagcagacacagcggaaagaacacaagagagaagaggaagaaaaagacgaaagacgaaagagaaacgaagagagagaaccacggacgaggaaggaccacacaacagcgtagggacacaacagcaatgaagcagcagcgacgacagagggcaaaagtccacgcaagtgcgcaggacagagcgcgacgagggaggacgacaca

SEQ ID NO: 425004 - DNA, 193 bp, Homo sapiens
tcacttttaaatatttaatgttttgctaattataaaagtcatatgtgttcattgggaacatttggaaaactgaggttttatgaagtgtccaatgatgtcctgccctggccccaggtggccttcctaaacagactcccttcttctccattttaggaagatcctagtacctccccctctccggggacccgagcag

SEQ ID NO: 425005 - DNA, 446 bp, Homo sapiens
ctttgacaagtgcagcgcagcatagaggaacacagcctccttgcaccttttgctatatctgcataatttccctctccccaggtgcgtgcatcctctaatgacaaagcaaccttgtatttccttccacaaatgaatggaggcagcctaacgtcatgtggtatgttccaggctcatgatagaggataagtacacctccttggctgtcaggtgacatctacattgtctacattttaggagttgttattgttattcgtgtttgtcattccttggacctttccttctgctggagaaacttcttgtttagcttctagagccatgttggtgggtcacagattccttggctcttcctcgtctggcttctgaaagagacgccatctggtgtaatgatggggaagggagagctagcagctaagagacctagattcctccagaagtgccagagggag

SEQ ID NO: 425006 - DNA, 475 bp, Homo sapiens
agcctgggtggggctcccaggagatggaacagggacacataccaggcaggtccacgccaggggtgcggggccctgatgaggaaccgggctgcactggtcatggctgcacctgagccgccgccacctgtcccgcagccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcatt

SEQ ID NO: 425007 - DNA, 5373 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 425008 - DNA, 5145 bp, Homo sapiens
cacaggcgcagaagcagcttgcatgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 425009 - DNA, 4836 bp, Homo sapiens
tagctagtagaggctgggtgttgaatcggccgaggctgaacatcatgaattcccaagaagggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 425010 - DNA, 5588 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatgtgaacatgcactaagtttatcattaacagagaagaaagaaggcttatttgaaagacgaaaagagccccaaatgtggagtccggtgacttgggcaggccctctgccatggcagagctggccctgggccaatggagttactgctccgaggaccagttccaccacctgaaaacctgcacccaggcatggccgcctcacagactgtgcgactgccagaggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 425011 - DNA, 2210 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatgtgaacatgcactaagtttatcattaacagagaagaaagaaggcttatttgaaagacgaaaagagccccaaatgtggagtccggtgacttgggcaggccctctgccatggcagagctggccctgggccaatggagttactgctccgaggaccagttccaccacctgaaaacctgcacccaggcatggccgcctcacagactgtgcgactgccagaggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 425012 - DNA, 5565 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaaaaaaactacaaaaaatctccgagggcatcctattgccggagcgcgcgcgacacaaccaggcacatgaacctggcgcccatttgcaagaggctggtccctggacccgagcttcctttgtccacagggtgcacgatctcccgggtctcccttatgggaagccgattaacttcagataagcagtgtacccggta

SEQ ID NO: 425013 - DNA, 5507 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
  misc_feature (5380)..(5380): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaaaaaaangaaaaaaaaaaaaggggggtttagtggggggggggaaaagaggagtaaagggccgggcatgggtttcggaccgttttgtaaagggggaaaggggggcccaaagggaggggaaaaagaaacgggaccg

SEQ ID NO: 425014 - DNA, 5445 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcagtggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaacccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacagtaataaacggtttactgtccgcaccctcgggctcaggccctcgcattggtccatcacgctccgggctggggatgccccttttcagagaagggcccgggaccacggtgaccaggagtcgtaggagcaagatggcggtcttcgacaggaagctgggctcagaacattcccaagccccgggaagg

SEQ ID NO: 425015 - DNA, 1858 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagtttaccctttctacaccttggcgtttgactttaaaccctttcttcaattccttttttccttttttttgttgacgattaatcatct

SEQ ID NO: 425016 - DNA, 862 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtggaactgagcagcaaaaaacaaaagacaagcccccaacataatagaaagaaacaaaagcaccaacaaaaaacaaac

SEQ ID NO: 425017 - DNA, 823 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (66)..(66): n is a, c, g, or t
  misc_feature (70)..(70): n is a, c, g, or t
  misc_feature (793)..(793): n is a, c, g, or t
cgatcttccttccggagcncgncagcntatatatcantcaagtnactccttctgacatggctccgnaagnaagatcgcgagtccggaggatggacaaagtaaggaagatgccacgggaatatggcggcggcggcggcgagtccggactaggcccgaagcgcgcgaccgcctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtggtcgcncctgagttgggatcctctagaacagcctca

SEQ ID NO: 425018 - DNA, 1029 bp, Homo sapiens
ggcacgaggctccgggcggccgcacctgccagttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgta

SEQ ID NO: 425019 - DNA, 6429 bp, Homo sapiens
agtcattggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggtaagaagaaaatacgatgggacccagttaggaggcgcttcattcagtcctgtcccatcataaggatccctaacaggtttttgagaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaatagattgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaa

SEQ ID NO: 425020 - DNA, 6453 bp, Homo sapiens
aactgaaaccaaccaacctatcctgtgatctaccagaagagagataccgacatgaaattgcactggacgggcagaggatatacctcttgggaggtggtacttcatggaccgcatattccttaaacaagatccatgcatacagccttgaaacgaatgcttgggaggaaattgcaacaaaaccccatgaaaaaataggctttcctgcagcccgaaggtgtcacagttgtgttcaaataaaaaatgatgtcgggggcagtgggggcagcgggggtcgggggactggccagctcaaccgcttcgtgcaactctccgggcggccgcacctgccaggtaagaagaaaatacgatgggacccagttaggaggcgcttcattcagtcctgtcccatcataaggatccctaacaggtttttgagaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaatagattgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaa

SEQ ID NO: 425021 - DNA, 6257 bp, Homo sapiens
agtcattggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggcgggggcagtgggggcagcgggggtcgggggactggccaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaatagattgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaatttggttcaagttcaaaaagattg

SEQ ID NO: 425022 - DNA, 1683 bp, Homo sapiens
agtggatccccgcgacaggtgcgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaa

SEQ ID NO: 425023 - DNA, 1039 bp, Homo sapiens
gtttttttctgattactgcctctgactccaccctgtacactgactaagcagggcccttaaaaaacttataaaaagttgttttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaa

SEQ ID NO: 425024 - DNA, 1040 bp, Homo sapiens
  misc_feature (1000)..(1000): n is a, c, g, or t
agtcattggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggtttcctgcagccganggtgtccagtgctgccactcaaactgatgtattaacgcgg

SEQ ID NO: 425025 - DNA, 430 bp, Homo sapiens
taagaagtattattaggaagtatatccatgttataaatctaaacaaataagaagtatatccatgttataaatccttcctggtccccttttatggctaaaatggttgttacctaattttgtttgtgcttttaaactggtaggacacctgtggaaaactgtcctcttctctcctaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacgtgagtgcaagcagttcgtaactcctgactttat

SEQ ID NO: 425026 - DNA, 598 bp, Homo sapiens
gtcctcttctctcctaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacgtgagtgcaagcagttcgtaactcctgactttatgaaatgtctgagaagccaggttcaatgtcccatattcctcattaataatttataacactataatgtgatttcgccctgtgggtggataggctttttactagggtaataacagtatggtgattccaaattatttgggtcctgagtttgaattcagcttgtcaggtgagttttagctttaatttcctaacttgcaaaatgggattaataatatcttagagggttcaatataaagtatcacgcagtagaaggtcaacaaatggggcttatgacgatgacagttaatagctgttgagcaaagtacaggcatacctcagagatgtcctgg

SEQ ID NO: 425027 - DNA, 6233 bp, Homo sapiens
agtcattggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggcgggggcagtgggggcagcgggggtcgggggactggccaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaatagattgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaa

SEQ ID NO: 425028 - DNA, 6342 bp, Homo sapiens
agtcattggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaatagattgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaa

SEQ ID NO: 425029 - DNA, 5846 bp, Homo sapiens
ggcacgaggctccgggcggccgcacctgccagttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaatagattgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaacaaaaaaaaaacaactttttataagttttttaagggccctgcttagtcagtgtacagggtggagtcagaggcagttttcagaaaaaaacaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaa

SEQ ID NO: 425030 - DNA, 4294 bp, Homo sapiens
agtcattggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggtaagaagaaaatacgatgggacccagttaggaggcgcttcattcagtcctgtcccatcataaggatccctaacaggtttttgagaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaatttttatgagacaccattgggtttaccccccctggtgttgataaaacccgggtttttaaagccctgc

SEQ ID NO: 425031 - DNA, 712 bp, Homo sapiens
agtcattggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcactgttcacagcatcttcactaggagtagattctatctcaagaaaccactttcactgagcacagtgactcatgcctgtaatcccagcactttgggaggccgaggcaggaggatcgctggagcccaggagttgaagaccagcttgggcaacatagtgagaccttttctctacaaaaaataaaaaaat

SEQ ID NO: 425032 - DNA, 1760 bp, Homo sapiens
agtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccagtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacaaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagttttatccttcaccttttccagtatctggttaaccactagttcttgagttttggtatgaagtgtacgttatgtatgtcatcatggactttcaactagaaaaggtaatgataaggttttctgaaga

SEQ ID NO: 425033 - DNA, 1347 bp, Homo sapiens
agtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccagtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacaaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagttttatccttcaccttttccagtatctggttaaccactagttcttgagttttggtatgaagtgtacgttatgtatgtcatcatggactttcaactagaaaaggtaatgataaggttttctgaaga

SEQ ID NO: 425034 - DNA, 1730 bp, Homo sapiens
agtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacagtcctatctcctgccgccccagcctgtcaagcagttcctcatctcccctccagcctctcccccagtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacaaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagttttatccttcaccttttccagtatctggttaaccactagttcttgagttttggtatgaagtgtacgttatgtatgtcatcatggactttcaactagaaaaggtaatgataaggttttctgaaga

SEQ ID NO: 425035 - DNA, 2506 bp, Homo sapiens
tggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttaaatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaagtgaaggaaatattttcaggaagtttttctcaacctacaaaagctttaaaaataagaaattgacaagtaactagactatgatatgcctttgctttcatcacaaaagttcatcagcaaacaggaaaaaaaaagacccctaaaaagcctaaagctttaaattgtctccaaattcttaaaattagtcatctgtcttagatgtacatttatttgtcagcaaccttgtctgatttgaaatagatgatatgataaaacatgcattaacatgagtagtttatttttgttgggctccagagtgtaagaatattttattttttgtttgacataaaaagtgaagttgacttgcgtgaataacaatccagcatgctttcattctttctgaataacacagaataactgtgctacagcttctggattagttgtctatttccagttagaggagtgtgtgacatttatggtttgggaatagcatatttctaaagcataatataatacaagaaatagtgatgctctgttttcacaaatttatcttttcattcacccatccatccatttaacagatatttattgagtgcctatcttaggtgtaatagtatttaagactgaaagaaggagaatttctaacctgtcataagagtaaggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttatatgtcagtgccaactttgaaggtaaaacagtagtagtaacttttgggagaaattctaaaaactactttaaaaagaagcgtgcacataaaataaatatctttctatccaaggcttgtcattttatatgcttttattgtaaatttaatatatactactttaaaaaattgaactatacagaatttataaaatacaactttctctacttaccccacctcttattttctaggggtaaccactgttaatggtttggtatgtgtccttccagacactttctacaaatatacaaataagtgtgtttgtgtatgtgtctgtgtgtgtattcattttatacaaatagaaaaatattcttactgtgctgtgactctttgtcattttattatatattaatagatacctttccataagcgtttaaatagatttacctcattcttttataaattactgcataatccattgtaggagtatactttaacttattgaattagtcccctgttgaatggactacaagattattttcacttctctattacaaagaaagcaagagtgaagacccttttgcatatatttttgtcaccttgcatgaacatatccataaggttgtacatttgttttttacaagatctttgtaataaacattttaatgtaatttcaggagatgaggtcatagagataatatgagacccttttttggataaaaagaaagattgtacaggagtgcataatttttaaagaaaatcgtcttttgaagggtaatttcctttctgcctgattagccaaataaataccttgccaaaacttacaataggaaattttttttcaataaaaataaaatttgagg

SEQ ID NO: 425036 - DNA, 3348 bp, Homo sapiens
atcggaactgtccatgtactactgggggcggggctgccaagggaggaggaagatggcggcgggggcgaggtggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgacttttttttttggttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactata

SEQ ID NO: 425037 - DNA, 3854 bp, Homo sapiens
atcggaactgtccatgtactactgggggcggggctgccaagggaggaggaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgacttttttttttggttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactata

SEQ ID NO: 425038 - DNA, 3178 bp, Homo sapiens
cagagctgtgactgaggtgcggcctgggtgtgatttcagtcgacggggtcaggggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgacttttttttttggttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactata

SEQ ID NO: 425039 - DNA, 2669 bp, Homo sapiens
atcggaactgtccatgtactactgggggcggggctgccaagggaggaggaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaact

SEQ ID NO: 425040 - DNA, 762 bp, Homo sapiens
atcggaactgtccatgtactactgggggcggggctgccaagggaggaggaagatggcggcgggggcgaggtggctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagtaagtttttttatatatatatacatatatatgtatatgtatgtgtgtgtgtttagttttgtcacacgaggatacagtatgaaagaaaatatttttgtttctttcacaccataaagcctgattcttttgttgttaatacctgttaaatttctgaaatttaaagacctatgtaaaaatggtttcgagacaatgaaatttgtagccactcactcgcatgaggatttaatggtaaaggagatgacctttgaggatctt

SEQ ID NO: 425041 - DNA, 3908 bp, Homo sapiens
atcggaactgtccatgtactactgggggcggggctgccaagggaggaggaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgacttttttttttggttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactata

SEQ ID NO: 425042 - DNA, 3854 bp, Homo sapiens
atcggaactgtccatgtactactgggggcggggctgccaagggaggaggaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggacaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgacttttttttttggttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactata

SEQ ID NO: 425043 - DNA, 4812 bp, Homo sapiens
atcggaactgtccatgtactactgggggcggggctgccaagggaggaggaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgacttttttttttggttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactatagtattatgtgaatgctacatttgttctgaacacttaggggctgcaaaaatgtaataagaaatgcatatgactagatagcaatagtgttttttttagatggtatgctcttgattgaaatatattctcacttttaccaggttaaacatttggaatcttataatgttacttgctttttgatagataatagtgaaataaattcagctttgccattgctggagttgtcaaaattccacagtaattaaaatttgaatttttaccgaatatgaaatttccaaattaaaaacgtatatgtgtactcttttaaaaaggaatttgatagttcttgtcaaatgagaaaatttaaaggtaagagttatggtttgtcttatgctgcatagactattcacctcctaacttgaaggtctaatcataagacaattgtttttttgtgcatagttttcatctaaaattaagtttaccaaaggcaaataactgcttactaggaacttcctttagcaaaaattactataaagttcaggacagtttgaaataaaacccaggaaacaagattaatgtgagcagttctccaagatcctaactggtgggacataaactatgatgcaatggataggaaaaggtagtgcaaaaagaatttcttaaggtttaaaaaatacacttttcattataggaaaaagaagattcagagaaacaaaggaatgtaaccttattgattacatttttggtgatcaccgagaattttttgtactatattttaaaaaatgtattctactgtaacaagttaataaagagattttttaaaaaactataaactagaaattgagagtcttgcattctcttttgtatttgattattgtgtctggatataaattacaatagcacatgaaaataaaatgttttaaaaaaa

SEQ ID NO: 425044 - DNA, 602 bp, Homo sapiens
gaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactta

SEQ ID NO: 425045 - DNA, 569 bp, Homo sapiens
ttccacttccgcttccggcgctgcggcagtccagatcagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactta

SEQ ID NO: 425046 - DNA, 1860 bp, Homo sapiens
gggggggacccgtgctgaggcggcggggcgacgtgggctgcggtgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaacaggcacggcctcgtgcccttcgccttcgtgcgcttcgaggacccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425047 - DNA, 627 bp, Homo sapiens
ctcaacagaaggcaaggacccacctcatgagagcggaatttggtgtcatccagtttacgcagggcatattccatgtcttcttttctgagatactcgaccatccccactccatccttctgcacatcagcataacagacatccccagcttctcgcatgtgatccttcaggtcctgccagctgcctgacggaggaagtcctaaagaactcggaaatcagatcttcttgtaggaggcccattcctcccaccacggggccacccaccccgacctccataagtcctggggaactccacacgaagccgacactggccataatcataaccatttcttccataaatagcatcctctgcatctctaaaaaaaacaacaacaacaaaaaaaacgtttggagttagtgctgttcaggaggccaagtgactttccaagtgaggggcatgagtagtaagcataaaagggaaacctagagtgaagaaaaaaacacacaaatcaggatcctgaagcacttctgctttggtttggagacgtttcatgatactggaattaacctttacagctgtcacacgcagttttagaggtatgaaattataatgaatgagcaaacagattactcataagagggctaattcag

SEQ ID NO: 425048 - DNA, 1841 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctcatgagagcggaatttggtgtcatccagtttacgcagggcatattccatgtcttcttttctgagatactcgaccatccccactccatccttctgcacatcagcataacagacatccccagcttctcgcatgtgatccttcaggtcctgccagctgcctgacggaggaagtcctaggcatggagaacataagaaagcccacatccttcagctatgttaactgccctgttaagagccagcaatacctatggtcccttctccatgatcacttaaatcctgagggtccccaaatcataaaccttgataagggacatgaaatcagaaaagagcactgaagtatgtgtggtaaatgaaccactttgagaagctggttttaagttcatcttccagagaccaggccttttcaacagagcaagaagtccatcccattacaggtttagtatctttgagaattcatagcctctttctttgtcctttaaaatcaatgccaaactcctaatactttgagttccaattttttccattatgaaatttaacagtaccaattatttattgcttgacagggtttcacaggacatgggaattttgaaaccagacatgaaataaccaaagagtagctgaaggtaacaacacaacaacaaaaaatctaaagtttgttttcttgtaggtatgaatgacaaactatacagagtacctcttaaaagatcaccaacattcttcaatacagtgggggggaaggtaagactcagatgctaaaactagtcgggagtcatacaaccctacctgatgtcatgaaagggaaatgtgctcctgctctcaaaggctgtgtttaccgctcacagctcaggactgcagccatttcctaatagttttctaagcaggatttcagagcagcatggagagaaaaaaagataatgtatgacatcctgaaggagggaatagagttctggggttaaaaaattacaaagggacacaa

SEQ ID NO: 425049 - DNA, 1469 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctcatgagagcggaatttggtgtcatccagtttacgcagggcatattccatgtcttcttttctgagatactcgaccatccccactccatccttctgcacatcagcataacagacatccccagcttctcgcatgtgatccttcaggtcctgccagctgcctgacggaggaagtcctaaagaactcggaaatcagatcttcttgtaggaggcccattcctcccaccacggggccacccaccccgacctccataagtcctggggaactccacacgaagccgacactggccataatcataaccatttcttccataaatagcatcctctgcatctctaaaaaaaacaacaacaacaaaaaaaacgtttggagttagtgctgttcaggaggccaagtgactttccaagtgaggggcatgagtagtaagcataaaagggaaacctagagtgaagaaaaaaacacacaaatcaggatcctgaagcacttctgctttggtttggagacgtttcatgatactggaattaacctttacagctgtcacacgcagttttagaggtatgaaattataatgaatgagcaaacagattactcataagagggctaattcag

SEQ ID NO: 425050 - DNA, 1014 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaaaaaaaggaaaaaaaaaaaaaggggggggggcgaaaagaaaaatcaccaggggagcgcaccccaaaaatacaggcagcacacacagatgtactataacaagaggaggccgcccacaaaaagagcagggactaaataaagaaaacaacggggcgataacaaaaacgacagtgttggagtgcaacaacatcttacgaggggaggcaaactgtgaagagaggacgaccaaccacaatcagtgggggggggagacacctggagggaccaaaagaaccagcgaaggaaattgaagacaccgaagagggataataattagtatctcgaacagtattaaagtggtgaaaacggacggctttagctacggccggtcgagaagattgtcgaaggacatatatgggaaaat

SEQ ID NO: 425051 - DNA, 903 bp, Homo sapiens
  misc_feature (758)..(759): n is a, c, g, or t
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaattgggggcactatgtgggggggggcaaaagggggtaggaatgggctgtggataggggttccggaacccagttttcgggtccagggggaggatctcgcggtccctatagggggggataattcgataagcaggtaccgtgtagtctctgggggaaacnntacacggagacacagcgcaacggagactacacttagatcacaaacggggcaggaaagcgaacattgacagcaaatatcggcacaatcaaaacgcacaatgaaagacaagaaaagcaagaagagcaagcacaagcggagaagcga

SEQ ID NO: 425052 - DNA, 4251 bp, Homo sapiens
ggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtgatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttgagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425053 - DNA, 4032 bp, Homo sapiens
ggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtgatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaaccctggagtgcagtggtgacagatcactgcagcctccaactcctgggctcaagtgatcctcccacctcagcctcctaagtaactgggactacatatgtgcatcaccacgtccagttaatttttttttgagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425054 - DNA, 4431 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtgatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttgagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425055 - DNA, 4349 bp, Homo sapiens
ggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggttggagtgcagtggtgtgatctccgctcactacaaactctgcttcctacattcaagtgattcttgtgcctcagcctcccaggtagctgggattacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtgatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttgagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425056 - DNA, 769 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttacacttaaaaaaaaaaacaaaaaaacaccccagtttatactttcttcaatactcacaaacacaaaaaatgaagaaacacaaagtattataaaataacgggcaagaaaacagaagggataaaaacagagcaccacaaagagaaaaaagcgcggacgacacccaacaaaaaaagagacagacaaacaacacacaggaaaaaaca

SEQ ID NO: 425057 - DNA, 2344 bp, Homo sapiens
acgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425058 - DNA, 2505 bp, Homo sapiens
gaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425059 - DNA, 3621 bp, Homo sapiens
ggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtgatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttgagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctcatgagagcggaatttggtgtcatccagtttacgcagggcatattccatgtcttcttttctgagatactcgaccatccccactccatccttctgcacatcagcataacagacatccccagcttctcgcatgtgatccttcaggtcctgccagctgcctgacggaggaagtcctaggcatggagaacataagaaagcccacatccttcagctatgttaactgccctgttaagagccagcaatacctatggtcccttctccatgatcacttaaatcctgagggtccccaaatcataaaccttgataagggacatgaaatcagaaaagagcactgaagtatgtgtggtaaatgaaccactttgagaagctggttttaagttcatcttccagagaccaggccttttcaacagagcaagaagtccatcccattacaggtttagtatctttgagaattcatagcctctttctttgtcctttaaaatcaatgccaaactcctaatactttgagttccaattttttccattatgaaatttaacagtaccaattatttattgcttgacagggtttcacaggacatgggaattttgaaaccagacatgaaataaccaaagagtagctgaaggtaacaacacaacaacaaaaaatctaaagtttgttttcttgtaggtatgaatgacaaactatacagagtacctcttaaaagatcaccaacattcttcaatacagtgggggggaaggtaagactcagatgctaaaactagtcgggagtcatacaaccctacctgatgtcatgaaagggaaatgtgctcctgctctcaaaggctgtgtttaccgctcacagctcaggactgcagccatttcctaatagttttctaagcaggatttcagagcagcatggagagaaaaaaagataatgtatgacatcctgaaggagggaatagagttctggggttaaaaaattacaaagggacacaa

SEQ ID NO: 425060 - DNA, 2039 bp, Homo sapiens
ggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtgatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttgagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagaatggtaaccattctgatgttggagcggccgc

SEQ ID NO: 425061 - DNA, 452 bp, Homo sapiens
  misc_feature (365)..(365): n is a, c, g, or t
  misc_feature (367)..(367): n is a, c, g, or t
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctaccnanaaagggaaaattttggggggcaaaaaaaaaaaatttttttaaaaaaaaaaataaaagggggggcagaccgttactctgcacatgg

SEQ ID NO: 425062 - DNA, 505 bp, Homo sapiens
gggcaacagcgagactctgtctcaaaacaaaaacaaacaaacaaacaaaaattctcttttgttattttcaaacaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgac

SEQ ID NO: 425063 - DNA, 568 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactta

SEQ ID NO: 425064 - DNA, 739 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttactaaaaaaaaaaaaaaaacttgaggggggcccgttcccattcgcctataggagtcgattacaatcactggcctcgtttacaccgcggactggaaaccctggcgtaccaacttatcgccttgaacatccccctttgcagttgcctaattacaaaggccgaaccatgccctac

SEQ ID NO: 425065 - DNA, 2471 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgatccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggaggcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactctgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaaaaaaaaccatgaat

SEQ ID NO: 425066 - DNA, 1242 bp, Homo sapiens
  misc_feature (1080)..(1080): n is a, c, g, or t
  misc_feature (1170)..(1170): n is a, c, g, or t
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctcatgagagcggaatttggtgtcatccagtttacgcagggcatattccatgtcttcttttctgagatactcgaccatccccactccatccttctgcacatcagcataacagacatccccagcttctctggcccgatttatcatatcccttttctcctccaaatgtttctcctctcaccttttctctgggacttaagctgctatatcccctcagngctcacaaatgcctttacattctttccctgacctcctgattttttttttcttttctcaaatgttacctacaaagacatgcctggggtaancacccggctccctaattcctcagtaacctccatctaaaatctccaaggaagcaataaattccttttatgaga

SEQ ID NO: 425067 - DNA, 832 bp, Homo sapiens
agtgccttccccgggctgcaggaattcggcacgaggagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagcggatcagcgctgatccgcttaagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatgtctagaaacccca

SEQ ID NO: 425068 - DNA, 1812 bp, Homo sapiens
ggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtgatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagctcccagctacttgggaggctgaggcaggagaatggcgtgaacccgggaggcggagcttgcagtgagctgaaatcgcgccactgaattccagcctgggtgacagagcgagactct

SEQ ID NO: 425069 - DNA, 1306 bp, Homo sapiens
ctaatgtgtcttagatttaccaactatcctaatgtgtagtcaattgataaactaaatttttctttaggatagttcacatccagtagaacttctaccttggaaaacattcttagccttgtttattttgaatgtatgtgtgtgtgtgtgcatgtgtggaaaacaagaaaaatacaagctctagagtagtggcctcacattgatttatattagtgtgccagtctttcccctacctccctaatatttcaaacttcttgtggacaatgacattcattttcatacctttatatttccagtgccaccagaaacacaaaagcagcttagtgttgatttaatgaagtagcaaaatgttaaatacataacaaaacagattgtcctgtcacctaaaacaaattagtgatgtttgagtaattagggttttgcatgtgtatatagaaaggctattttgcaaacagtggttcagtctgtattgggcacaggtgaattctgccctgcgattgccatctttagcacttttcagagaatttgttgccatttatgacactgatcttcagacacactgtgtagtgccttggcttaaactgtcagactggcaacagctgaggctgcccatcataggacacgttccttgcagttatgcttcagtgaactttaaaacatttggcactcgtatcttagaaatgtccttccgaaactcactctacaacagctttgtgggctccctactatttactagagtcaatcctgattttgtttggcataatgagacctgatatgctatgactctccctatcctataaagccacagctttcagcggtccccgtatactaatgaaatggagtcgccagtatccaaaagttccaagtgattatttagaacatttccattaaccataaaggcaaagtggtatagagaaaataatacagtctttgaagtcacacaggcctgatttcaaatcccagctctgtcatttacaaactgggtggtcctggataaattacttaacctctgtggtcttcagtttcctcccaactttgtagggttattgtgagcattgaatgataccaagttataagtgcataggtattcaatcagtgttcattcccttctgtatcaaagacttataatggccttttcatggaattgtctctacctataattatgtgactgtgccttcagattatcaaaattatatgaattgtccatgtgcccttggttttgaatgttcaattctgtattgcaggaatgcctactcagttgcttgaatgggtgtttggagttaataaaatggctgtacaattgaaaagg

SEQ ID NO: 425070 - DNA, 782 bp, Homo sapiens
taggcatggggagcaagttggaaagtgaggttattattttttttccttaaaattggtgttactgtctttagtggcttgaggctaaagaaagctgatactttatctttgccaaataattatttataagatttatttttaaataagcccaatctctcacctgcagttaagaatcatcattttctgtgactgacactaaagctcttccttatcagagcttgttctcaatctgtgatcacagtccacagtggcaaagacaactctttgattaggaaggaaaccatgtttgggatgcacagaggtgccctgtccatacggttttcttcttacatgaaagaattgacctttctgttgacctataccattctgtttttataaagtgggattagaatttgagcatatctagtaaatgccgtgtggtcagtccgctgatgcttgcccgccgtctttgccgtgccttggcatcctaggggtgctggtgatggtcagtgggcatcatcggtcagcagtgcacgtgtaaggcaatctcctctcctccaggttagttcagaaggtcgttgccagttccactattcttcatcttcaccaccttctactggtcagtctttcatcactcagcctccgaagtgctgggattacaggcgagagccactgtgcccctccctgagtagagtgatctgaacagagcatccacagatgggcggtgtttggacattcagaaatggagaaggtgttccaggagaagcaagcagcatgagcagttgggatacctcgtagtttgtgta

SEQ ID NO: 425071 - DNA, 4434 bp, Homo sapiens
  misc_feature (4434)..(4434): n is a, c, g, or t
catttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctcatgatgaaactgctttgatgaattcctgtgtgatgaattctgctatatttccttttgacttttctcagtttgtgacattctgtattaactttgctgcagctctctagaaaacttgcatccctatatattgtgcctttaaagctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttctttttttttttttttggcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcacaaaagttaggagccacttgtttctgcacagactgtaggagcaagatgaggagatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagtaaaaaaaaaacacacaaaaaccaacacaacaaacacacacacacacccaacaccaacacacgaccaaccacaacccacaaacaacaacacaaacacaaaaacaagacacacaaacagcaccaccccaccacccaccaccaaccaccacaacaccccaacgaccaacaacaaacaaccaccccagcacaaaccaaaacacaccacggcggggccgcaacccactccacaccgggagacacccaaaccactacagaccaactaacacgacgaagcacaagacagccccctgcaccgaccggataccaacgtccactacacagacaacgccgcaccaacgacacaaccaaaccgaggagcgaagaaacacaacaccgcaagcagacgctaacaagagaaccaaccaccccaccgcgggacaccaacacagccagacccccaccacccagcaaactccccacaccgaccacacaaaacgcacccgccagccgcaggcaccacacacaaacgtccgcccacctccatacctcccccgccagccaaacgacacaaaaccaccggcccaagccgatcaagaccgcccagccagcaacaaacaagctgacagacacaaccggagagaacggcgcatccaccacgaacgcaagcagaatcagccaagcccaagccaaccacgtcacccaaagcgcgcaccagaccgccaacaacatcgagacccagcacacacacgccaacaacaccaggccgcaacaactcacccacagcaaagaccaatcatgacacaaan

SEQ ID NO: 425072 - DNA, 4228 bp, Homo sapiens
catttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctcatgatgaaactgctttgatgaattcctgtgtgatgaattctgctatatttccttttgacttttctcagtttgtgacattctgtattaactttgctgcagctctctagaaaacttgcatccctatatattgtgcctttaaagctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttctttttttttttttttggcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcacaaaagttaggagccacttgtttctgcacagactgtaggagcaagatgaggagatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagtaaaaatttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctttggccccccctcgccccctgttttttttaacccggccaagttttttctgccccccccattttggttctttttgcccaattccccctaagggggggggttaaaaaaatcacgggccgggttttaaaaacgggggggtgggaaaaccccgggggttccccaatttaatgcctttgaaaacaaccccctttttcccggttggggaaaataaaaaaggcgcccccccccccccccttccaaaaatttccccaccctataggggcaagggaaatctgacgcgtaaattttttgtaaaatcgggctaatatttttgttaaaaacactttttttttaacccaatgggccccgattggaacaatccctttataacaaaaaaaatcccccgcggagggctttggggtttcttcccattgaaacgagagccctttttaaaggcgggtgccccaccccgaaagggga

SEQ ID NO: 425073 - DNA, 4380 bp, Homo sapiens
  misc_feature (4380)..(4380): n is a, c, g, or t
catttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctcatgatgaaactgctttgatgaattcctgtgtgatgaattctgctatatttccttttgacttttctcagtttgtgacattctgtattaactttgctgcagctctctagaaaacttgcatccctatatattgtgcctttaaagctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttctttttttttttttttggcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagtaaaaaaaaaacacacaaaaaccaacacaacaaacacacacacacacccaacaccaacacacgaccaaccacaacccacaaacaacaacacaaacacaaaaacaagacacacaaacagcaccaccccaccacccaccaccaaccaccacaacaccccaacgaccaacaacaaacaaccaccccagcacaaaccaaaacacaccacggcggggccgcaacccactccacaccgggagacacccaaaccactacagaccaactaacacgacgaagcacaagacagccccctgcaccgaccggataccaacgtccactacacagacaacgccgcaccaacgacacaaccaaaccgaggagcgaagaaacacaacaccgcaagcagacgctaacaagagaaccaaccaccccaccgcgggacaccaacacagccagacccccaccacccagcaaactccccacaccgaccacacaaaacgcacccgccagccgcaggcaccacacacaaacgtccgcccacctccatacctcccccgccagccaaacgacacaaaaccaccggcccaagccgatcaagaccgcccagccagcaacaaacaagctgacagacacaaccggagagaacggcgcatccaccacgaacgcaagcagaatcagccaagcccaagccaaccacgtcacccaaagcgcgcaccagaccgccaacaacatcgagacccagcacacacacgccaacaacaccaggccgcaacaactcacccacagcaaagaccaatcatgacacaaan

SEQ ID NO: 425074 - DNA, 2819 bp, Homo sapiens
  misc_feature (2819)..(2819): n is a, c, g, or t
aggcaattgagagatagaactagttctctctctcctgtgcctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttctttttttttttttttggcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcacaaaagttaggagccacttgtttctgcacagactgtaggagcaagatgaggagatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagtaaaaaaaaaacacacaaaaaccaacacaacaaacacacacacacacccaacaccaacacacgaccaaccacaacccacaaacaacaacacaaacacaaaaacaagacacacaaacagcaccaccccaccacccaccaccaaccaccacaacaccccaacgaccaacaacaaacaaccaccccagcacaaaccaaaacacaccacggcggggccgcaacccactccacaccgggagacacccaaaccactacagaccaactaacacgacgaagcacaagacagccccctgcaccgaccggataccaacgtccactacacagacaacgccgcaccaacgacacaaccaaaccgaggagcgaagaaacacaacaccgcaagcagacgctaacaagagaaccaaccaccccaccgcgggacaccaacacagccagacccccaccacccagcaaactccccacaccgaccacacaaaacgcacccgccagccgcaggcaccacacacaaacgtccgcccacctccatacctcccccgccagccaaacgacacaaaaccaccggcccaagccgatcaagaccgcccagccagcaacaaacaagctgacagacacaaccggagagaacggcgcatccaccacgaacgcaagcagaatcagccaagcccaagccaaccacgtcacccaaagcgcgcaccagaccgccaacaacatcgagacccagcacacacacgccaacaacaccaggccgcaacaactcacccacagcaaagaccaatcatgacacaaan

SEQ ID NO: 425075 - DNA, 1075 bp, Homo sapiens
tcggcaaggcaagtccactggcctgtgcatcggacctctgagtaaaccaacatgtgtcagactgtggacatgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425076 - DNA, 756 bp, Homo sapiens
cacgtgctgctagacggaacggggcggggcaggccacctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425077 - DNA, 1720 bp, Homo sapiens
cacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccgcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425078 - DNA, 3562 bp, Homo sapiens
cacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccagggtaagccggggcgggtccgaggtgctccccggggtactctgaaagccggggagggggcgggaccgagggcggaggcgggtcccagtcgccaggtgcgggactgctgcacctgtgactgggcgaggcttccttccctccgtaatcgcgaccacagcctagggacggaagggggttctgagcaacctgatagaagtgccaattatgagaagccctccgagcttggtcagagggttgaagatcagaaggacttccctaccaccgtggagcatcagtgggggtgtaagtgatcccagcccttctatttgcttcctctccagcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccgtgagttacacatatctatgaaatgggccctgtttcctggatcctctttctgatgtcttggttctagaccctgaccttccggctattagccaagtgcttttgatgatacccaggtttcagttccaggtgtctcacacagccatttccccagaagccactcaccaaagctaatgttcactttctctcacttttacacctagcctagttcctatttgcaaatctcatgatatagtctttcttttatttctccttcctggttagcaccttatttttctgatctcataaagtgtttttggagggaagtggaggggattgggattagaggtttgcttgctgatgaccctattattctctagccaatcaagaatgcacccccagggaaaaaatatgttcgatgcccctgtaactgtctccttatctgcaaagtgacatcccaacggattgcatgccctcggccctactggtaagaggcataaggtggggaagggcctaagtggggaactggaaagtcaaaaaaggatgagcgtatacagagaatgtaaaggtgagagagcctagtgtttatttaggagaaaaggctttgaagcatgtgcctcaggaatgttatagctgtctttctcgtttctcaataaaaatattgagatgaaatgatgtcgtttcggagaatagagagccttggggactgggtgtgttatcctgaggtcggaggggaattggggacctgaagtttaaacagtgctctttctttctcaaggattcttgagggtatacagttgggggacagagtatcttaagtacagagaagtcgagtgacttaatagacagggagtgggggatgtggaacagggactgtgaagatttttaggattaaaaatttttcaaacacaagtttgaaaatacaagtctttttcttttgtatagcaaaagaatcatcaacctggggcctgtgcatcccggacctctgagtccagaaccccaacccatgggtgtcagggttatctgtggacattgcaagaatacttttctggtgaggaaggggtattgggaaggggaggggaaaggagactaagagtcatttcgagtatatttcttagagtaatggtaatgacccctgaaaggtctgtcctatgggaacatgttctgcatccccaccccaaggttctcattgagggagaccctgcttgtgctattatttttgttttctttctccatagtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgccgtgagtacccttgccccaacctctttcattctgcagcctcatctccataggctaagatttgggaaactgctaccctaaaaaaaagtggaagaaacttgggggactagtttgttttgttttaagatatggatgagctaaagtgcaaagtggctgatcaaacagactttattactactacaagagtgaaaaacagccttcctttctctgtaggatgaggataggacagtgaaattcttaatttaagagttgctatttttcaaacctggctcagttgtcagatattaagaaaaactgagatacagtgtgggatgggatgagtatgttacgcctaagggaaggaagctgatcagctctgcctttaagaaggtccctgagggtggctacatgtggataaggaacaaggactgaagcgtgagttattactgttcttagaactaataggaggtagtggagaccaacattaaccccatctttcttttcttctccctccttatcttcatcagtttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425079 - DNA, 1741 bp, Homo sapiens
cacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccaggcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425080 - DNA, 1620 bp, Homo sapiens
cacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgactgggcccgggggaggcctgaccccctccgcaccaccgtacggagccggtaaacatgccccgccccaggcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425081 - DNA, 2414 bp, Homo sapiens
cacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccagggtaagccggggcgggtccgaggtgctccccggggtactctgaaagccggggagggggcgggaccgagggcggaggcgggtcccagtcgccaggtgcgggactgctgcacctgtgactgggcgaggcttccttccctccgtaatcgcgaccacagcctagggacggaagggggttctgagcaacctgatagaagtgccaattatgagaagccctccgagcttggtcagagggttgaagatcagaaggacttccctaccaccgtggagcatcagtgggggtgtaagtgatcccagcccttctatttgcttcctctccagcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccgtgagttacacatatctatgaaatgggccctgtttcctggatcctctttctgatgtcttggttctagaccctgaccttccggctattagccaagtgcttttgatgatacccaggtttcagttccaggtgtctcacacagccatttccccagaagccactcaccaaagctaatgttcactttctctcacttttacacctagcctagttcctatttgcaaatctcatgatatagtctttcttttatttctccttcctggttagcaccttatttttctgatctcataaagtgtttttggagggaagtggaggggattgggattagaggtttgcttgctgatgaccctattattctctagccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425082 - DNA, 2058 bp, Homo sapiens
cacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccagggtaagccggggcgggtccgaggtgctccccggggtactctgaaagccggggagggggcgggaccgagggcggaggcgggtcccagtcgccaggtgcgggactgctgcacctgtgactgggcgaggcttccttccctccgtaatcgcgaccacagcctagggacggaagggggttctgagcaacctgatagaagtgccaattatgagaagccctccgagcttggtcagagggttgaagatcagaaggacttccctaccaccgtggagcatcagtgggggtgtaagtgatcccagcccttctatttgcttcctctccagcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425083 - DNA, 3059 bp, Homo sapiens
cacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccagggtaagccggggcgggtccgaggtgctccccggggtactctgaaagccggggagggggcgggaccgagggcggaggcgggtcccagtcgccaggtgcgggactgctgcacctgtgactgggcgaggcttccttccctccgtaatcgcgaccacagcctagggacggaagggggttctgagcaacctgatagaagtgccaattatgagaagccctccgagcttggtcagagggttgaagatcagaaggacttccctaccaccgtggagcatcagtgggggtgtaagtgatcccagcccttctatttgcttcctctccagcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccgtgagttacacatatctatgaaatgggccctgtttcctggatcctctttctgatgtcttggttctagaccctgaccttccggctattagccaagtgcttttgatgatacccaggtttcagttccaggtgtctcacacagccatttccccagaagccactcaccaaagctaatgttcactttctctcacttttacacctagcctagttcctatttgcaaatctcatgatatagtctttcttttatttctccttcctggttagcaccttatttttctgatctcataaagtgtttttggagggaagtggaggggattgggattagaggtttgcttgctgatgaccctattattctctagccaatcaagaatgcacccccagggaaaaaatatgttcgatgcccctgtaactgtctccttatctgcaaagtgacatcccaacggattgcatgccctcggccctactggtaagaggcataaggtggggaagggcctaagtggggaactggaaagtcaaaaaaggatgagcgtatacagagaatgtaaaggtgagagagcctagtgtttatttaggagaaaaggctttgaagcatgtgcctcaggaatgttatagctgtctttctcgtttctcaataaaaatattgagatgaaatgatgtcgtttcggagaatagagagccttggggactgggtgtgttatcctgaggtcggaggggaattggggacctgaagtttaaacagtgctctttctttctcaaggattcttgagggtatacagttgggggacagagtatcttaagtacagagaagtcgagtgacttaatagacagggagtgggggatgtggaacagggactgtgaagatttttaggattaaaaatttttcaaacacaagtttgaaaatacaagtctttttcttttgtatagcaaaagaatcatcaacctggggcctgtgcatcccggacctctgagtccagaaccccaacccatgggtgtcagggttatctgtggacattgcaagaatacttttctggtgaggaaggggtattgggaaggggaggggaaaggagactaagagtcatttcgagtatatttcttagagtaatggtaatgacccctgaaaggtctgtcctatgggaacatgttctgcatccccaccccaaggttctcattgagggagaccctgcttgtgctattatttttgttttctttctccatagtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactc

SEQ ID NO: 425084 - DNA, 545 bp, Homo sapiens
ccaacccatgggtgtcagggttatctgtggacattgcaagaatacttttctggtgaggaaggggtattgggaaggggaggggaaaggagactaagagtcatttcgagtatatttcttagagtaatggtaatgacccctgaaaggtctgtcctatgggaacatgttctgcatccccaccccaaggttctcattgagggagaccctgcttgtgctattatttttgttttctttctccatagtggacagagttcacagaccgcactttggcacgttgtcctcactgcaggaaagtgtaagtgattagggattgagctggtaattgatgtatggagtaaaaactacaaggccatagaaagcatccatttctatttgcctccccacaggtcatctattgggcgcagatacccacgtaagagatgtatctgctgcttcttgcttggcttgcttttggcagtcactgccactggccttgccgtgagtacccttgccccaacctctttcattctgcagcctcatctccataggctaagatttgggaaactgct

SEQ ID NO: 425085 - DNA, 336 bp, Homo sapiens
gctggtctcgaactcctgacctcaagtgatccacctcccaaagtgctgggattacaggcgtgagccactgtacccagcctactcttctacatcttttacagaaaactatgtaagacaaatgtagagctcaggtgagcacttggtaaccagagtttgagaagtataaattatgctgggactccctctatatgccactctaaacacagctccaccctccataagttaccttgattttcttttttgagacagggtctggctctattgcccaggctggaatgcagtggtagtggcacaatttcactgcaaactccaccttctgagctcaagccatcctcc

SEQ ID NO: 425086 - DNA, 426 bp, Homo sapiens
cgcgtatctataaaaacacaaatacccaagaaatgtaaaacaacaataggttgtttctggatttttctctacattttctttgtgagaaacatactgtgttgtggcacccttgctgcttttttttttttttctctgagatcgtgccactccactccagcctaagtgagagcgagactccatctcaaataaataaagtaaaattgtaaaccattatatattaacataagtaaaccatttagtggaacctgttttcaatgacgaaaacaatgagaaagatggttttgttttcacaaatctgtttggcttaactgacagcttctggattctccttccgaattcaaacttagtgtctccgttcagcttctgaaatgctctagcatatactcagagtggctgtggaaacagcatggaatgttggtgttgtgc

SEQ ID NO: 425087 - DNA, 486 bp, Homo sapiens
gccccctcacctctgatacaccgatcagtctgcgcactggactcgactacacgtaaaattgaggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacatta

SEQ ID NO: 425088 - DNA, 943 bp, Homo sapiens
gctaggtgcgaggctgggtggtgcccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaaggccgtgttaaaggcaacaggggggccccgattgtgtgttggggaaataagtgccgcctgtgaaattgg

SEQ ID NO: 425089 - DNA, 985 bp, Homo sapiens
caggagcctcccacgaatgggaaggttttattgaaaactacagctggatgtagatgttgctcatcttggtcagtacaaaggactctgctccttacgggggatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttcgttaatccttttgatgactcattccaagggaaattaaagggtgaaaaaaaaaaaagggggcgttaattttcctcaggagcccacagtgagcgatcacagggatctggaaacacagggccccatagggagcgcgataaagcgagccggcgggtacaagtcggccggccacaggagacgcggacccgggcaggaccaacagtggggccacaggcacaccacagaagaggccaaggcacaaagagcaggctagggacgaaggctaacggacggaggcccaggagacaaacgagactgagcagcacggcggagaggcaagaaggaaagcgagcgagggagaggcacgcacaacagacgcacaccgcacacgacagaagcaacagagagaa

SEQ ID NO: 425090 - DNA, 3369 bp, Homo sapiens
ggagcggtgctcgggtccggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattaaaaaaaaaaaacaaaacaacaaaaaaaaaaaaaaaaaaaaaaaacaaaacacacaaaacaaaaacacacaaaaacaaaaaacaagcacagaacacacaacaaaacaaaacaacacaagcgcagacacccacccacccccacgacacacccgcacccaacaggaagagacacactcacacacagacacggcgcatacacgacacccacagcacacaagcacaaccaacaacaaacaacatcacacacagcaacagaacggtagacatcaacacaaaacaaacagcacaccagagaagaaagacacaaaccacactcaggagcagaagacaaaagagaacaacacaacaaacagaaagaaacgagacgacggcaacaaacacacatacacaagcgaaccgaggtgcagacacactacactcctgtcgcacctcacaaaacaagacagtcaccacagagcaagaatcgcaccaagccaaacaggacaccagaaaacaacaagcacaccgcacgatcactcaccaccaatagaccaacaaggacgacaccggacacaaacatcacaaacacgcacagaacaagccaaaacaaacgtaagcacagtagcgccaccaaccaacacacgcaacacaacagacgccagcacacgcacaggactatcgaaaacggcagagcacaccagccacgcaacgacacgacacgaggagaggagcacgccacaccggccggcaacaacaaccacacgccaagcaacacgcaccgagacgcacaggcacacagcacagccccgaacagcaacgaacaacaccaaaggacagccccatcacgacgacgacccaacgacacaggcacacgccacgcaccaagcagcacaccagaaggaacaaaagaaagaaaaagcaggagacggaggaacagagagaggaaggacgaggaaaagaacacacaagagagaggcacgcgaaaagacgaggaggatcggacaagggagacaagacaaccaagagaaaagaggagggcaagagacaaggggaggaacagaggaggacgcgaggacagaacagcagggaccagagaggcacgccggacgcgccgcccgacagcagaagacgcgagggcggcacagccgaggagcaggacgagcggcccgcgacggccagaccggagggggacgaaggggcggagaacgaagaggcacgcgaccccgccagccagcggacagcgggacgaagcgcggggagcgcggcacaacacacacacgagcgaaggcgcgcgcggagaagccaagcgcacagggcacgagcgaagggcaggggcgcgacaacaggcagcgcagggaacacacaaacgcagcaacaacgcaagggagggacaggcgaaagaagcagcgaccgacggagaggcagaagcacgaaaaacaagaacaagagaaggaaaacggaaggagagaagagcaaaaacccacgcacagaag

SEQ ID NO: 425091 - DNA, 1681 bp, Homo sapiens
gagctggtggaaaggctatcacgggattctatttactatagaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacatta

SEQ ID NO: 425092 - DNA, 940 bp, Homo sapiens
ctgtagtcccagctactcaggaggctgaggcaggataatcacttgaacctgggaggcagaggttgcagtgagccaagatcacgccactgcactccagcctgggcgacagagcaagactccatctcaaaaaaaaagacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacatta

SEQ ID NO: 425093 - DNA, 657 bp, Homo sapiens
  misc_feature (32)..(33): n is a, c, g, or t
ggcgggggccgcaggcggaccgttagtttggnnggcttcgagtagaccagttgatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattacatgttaaccattgcagactgcaagcctgtttgtgtccttttaccctaaaatatatgaaggcttccttttcaagatttttttataagaagttcctacagaaagaatatttgtgggaaacctccctttcactaacttcagaatataataaaatattataaataaaatatagaatataaatatg

SEQ ID NO: 425094 - DNA, 1898 bp, Homo sapiens
ggagcggtgctcgggtccggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacatta

SEQ ID NO: 425095 - DNA, 1957 bp, Homo sapiens
gccccctcacctctgatacaccgatcagtctgcgcactggactcgactacacgtaaaattgaggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattaaaaaaaaaaaacaaaacaacaaaaaaaaaaaaaaaaaaaaaaaacaaaacacacaaaacaaaaacacacaaaaacaaaaaacaagcacagaacacacaacaaaacaaaacaacacaagcgcagacacccacccacccccacgacacacccgcacccaacaggaagagacacactcacacacagacacggcgcatacacgacacccacagcacacaagcacaaccaacaacaaacaacatcacacacagcaacagaacggtagacatcaacacaaaacaaacagcacaccagagaagaaagacacaaaccacactcaggagcagaagacaaaagagaacaacacaacaaacagaaagaaacgagacgacggcaacaaacacacatacacaagcgaaccgaggtgcagacacactacactcctgtcgcacctcacaaaacaagacagtcaccacagagcaagaatcgcaccaagccaaacaggacaccagaaaacaacaagcacaccgcacgatcactcaccaccaatagaccaacaaggacgacaccggacacaaacatcacaaacacgcacagaacaagccaaaacaaacgtaagcacagtagcgccaccaaccaacacacgcaacacaacagacgccagcacacgcacaggactatcgaaaacggcagagcacaccagccacgcaacgacacgacacgaggagaggagcacgccacaccggccggcaacaacaaccacacgccaagcaacacgcaccgagacgcacaggcacacagcacagccccgaacagcaacgaacaacaccaaaggacagccccatcacgacgacgacccaacgacacaggcacacgccacgcaccaagcagcacaccagaaggaacaaaagaaagaaaaagcaggagacggaggaacagagagaggaaggacgaggaaaagaacacacaagagagaggcacgcgaaaagacgaggaggatcggacaagggagacaagacaaccaagagaaaagaggagggcaagagacaaggggaggaacagaggaggacgcgaggacagaacagcagggaccagagaggcacgccggacgcgccgcccgacagcagaagacgcgagggcggcacagccgaggagcaggacgagcggcccgcgacggccagaccggagggggacgaaggggcggagaacgaagaggcacgcgaccccgccagccagcggacagcgggacgaagcgcggggagcgcggcacaacacacacacgagcgaaggcgcgcgcggagaagccaagcgcacagggcacgagcgaagggcaggggcgcgacaacaggcagcgcagggaacacacaaacgcagcaacaacgcaagggagggacaggcgaaagaagcagcgaccgacggagaggcagaagcacgaaaaacaagaacaagagaaggaaaacggaaggagagaagagcaaaaacccacgcacagaag

SEQ ID NO: 425096 - DNA, 2080 bp, Homo sapiens
ggagcggtgctcgggtccggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattacatgttaaccattgcagactgcaagcctgtttgtgtccttttaccctaaaatatatgaaggcttccttttcaagatttttttataagaagttcctacagaaagaatatttgtgggaaacctccctttcactaacttcagaatataataaaatattataaataaaatatagaatataaatatg

SEQ ID NO: 425097 - DNA, 1970 bp, Homo sapiens
  misc_feature (972)..(974): n is a, c, g, or t
  misc_feature (976)..(976): n is a, c, g, or t
  misc_feature (979)..(981): n is a, c, g, or t
  misc_feature (988)..(988): n is a, c, g, or t
  misc_feature (990)..(991): n is a, c, g, or t
  misc_feature (993)..(993): n is a, c, g, or t
ggagcggtgctcgggtccggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagaaannntnatnnnccatttntnnangatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcaggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattacatgttaaccattgcagactgcaagcctgtttgtgtccttttaccctaaaatatatgaaggcttccttttcaagatttttttataagaagttcctacagaaagaatatttgtgggaaacctccctttcactaacttcagaatataataaaatattataaataaaatatagaatataaatatg

SEQ ID NO: 425098 - DNA, 1060 bp, Homo sapiens
agcggagtttggatagatagccaattagggctagaatggggctgatggaccatgaactacagttaaggaattggctttcattattatgggaatatgtgcaagcttagtagaaatgaaaggctgaaaaagttaaaaagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattacatgttaaccattgcagactgcaagcctgtttgtgtccttttaccctaaaatatatgaaggcttccttttcaagatttttttataagaagttcctacagaaagaatatttgtgggaaacctccctttcactaacttcagaatataataaaatattataaataaaatatagaatataaatatg

SEQ ID NO: 425099 - DNA, 573 bp, Homo sapiens
aatacagacataatatttttataagtttagagaaatttttattggctaacaaatagtaccttgtgttatgtttgaatgcctttatgttcaactcagtatttttcccccttgttttttttagttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggtagcgcttggcttttttgagtgctttatatttgctcttcatatatgacactctagttatttgagcccttgtatattaataggggtttgctttaaccccgaaaaaaaaggaacgctttatttttaacctaaggccctaaaat

SEQ ID NO: 425100 - DNA, 5127 bp, Homo sapiens
  misc_feature (3123)..(3123): n is a, c, g, or t
  misc_feature (3131)..(3131): n is a, c, g, or t
tcatcgctgtcgggaacagcgatgactggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataataatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaataaaaaacaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcgggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgnggtgccangttagccactaaatctgaacttttaccctgctttcatcatggatttttttgtgtaacctgaaacaagtcaccaatgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctctttgtgaatacccatagcaatatgtaagattttattgaagtttcctgtgataactgaggaacactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaactgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggggaaaaaata

SEQ ID NO: 425101 - DNA, 4102 bp, Homo sapiens
  misc_feature (2098)..(2098): n is a, c, g, or t
  misc_feature (2106)..(2106): n is a, c, g, or t
ttgtttttacaatctagccttgacctggccttcagacttggtttctagctcatcctccccaaaactgcatgttttatcccagtggttcttaattctcaacatccatagtcctgcgcagaatcttaaagtttggttaagtgaaacagattttagaatttagtgtatatctcaaaggtcagaattaagaaattgccatgtttcttcaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataataatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaataaaaaacaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcgggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgnggtgccangttagccactaaatctgaacttttaccctgctttcatcatggatttttttgtgtaacctgaaacaagtcaccaatgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctctttgtgaatacccatagcaatatgtaagattttattgaagtttcctgtgataactgaggaacactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaactgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggggaaaaaata

SEQ ID NO: 425102 - DNA, 4974 bp, Homo sapiens
  misc_feature (2970)..(2970): n is a, c, g, or t
  misc_feature (2978)..(2978): n is a, c, g, or t
aatacagacataatatttttataagtttagagaaatttttattggctaacaaatagtaccttgtgttatgtttgaatgcctttatgttcaactcagtatttttcccccttgttttttttagttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataataatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaataaaaaacaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcgggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgnggtgccangttagccactaaatctgaacttttaccctgctttcatcatggatttttttgtgtaacctgaaacaagtcaccaatgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctctttgtgaatacccatagcaatatgtaagattttattgaagtttcctgtgataactgaggaacactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaactgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggggaaaaaata

SEQ ID NO: 425103 - DNA, 4449 bp, Homo sapiens
  misc_feature (2445)..(2445): n is a, c, g, or t
  misc_feature (2453)..(2453): n is a, c, g, or t
tcatcgctgtcgggaacagcgatgactggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataataatgatgaaaacttttaataaataatttcctgaggtgaaaaaccgatattgaagattcatttttcttttttccattcttcaggaccttcggcaagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaataaaaaacaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcgggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgnggtgccangttagccactaaatctgaacttttaccctgctttcatcatggatttttttgtgtaacctgaaacaagtcaccaatgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctctttgtgaatacccatagcaatatgtaagattttattgaagtttcctgtgataactgaggaacactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaactgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggggaaaaaata

SEQ ID NO: 425104 - DNA, 5073 bp, Homo sapiens
  misc_feature (3123)..(3123): n is a, c, g, or t
  misc_feature (3131)..(3131): n is a, c, g, or t
tcatcgctgtcgggaacagcgatgactggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataataatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaataaaaaacaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcgggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgnggtgccangttagccactaaatctgaacttttaccctgctttcatcatggatttttttgtgtaacctgaaacaagtcaccaatgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgatatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctctttgtgaatacccatagcaatatgtaagattttattgaagtttcctgtgataactgaggaacactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaactgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggggaaaaaata

SEQ ID NO: 425105 - DNA, 2257 bp, Homo sapiens
  misc_feature (253)..(253): n is a, c, g, or t
  misc_feature (261)..(261): n is a, c, g, or t
cgaagacgccgcgtcctccattcgggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgnggtgccangttagccactaaatctgaacttttaccctgctttcatcatggatttttttgtgtaacctgaaacaagtcaccaatgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctctttgtgaatacccatagcaatatgtaagattttattgaagtttcctgtgataactgaggaacactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaactgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggggaaaaaata

SEQ ID NO: 425106 - DNA, 2269 bp, Homo sapiens
  misc_feature (1033)..(1033): n is a, c, g, or t
tcatcgctgtcgggaacagcgatgactggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggtagcgcttggcttttttgagtgctttatatttgctcttcatatatgacactctagttatttgagcccttgtatatcataaggcatagaattaggtctgaggagataaagtggataggtgtaacctaggccctaaagttcatcgttcagtagcagagtacatataggaataaccaaccctgatctggtggcaactagaggtaggaacagagtgctttagaggtacaggaaagaacgtgatgctgacaggaagagctggagatggcttcacagaggaggtgaatatttcagctgggcctagtcaactaaaaagtattttgacagtgattttccaggtagatgatggcatgaacaaggtcatgaaggtgagacagtgtattacctgctctggaaggtagtagcctggtacgtgtgtagaatatggatcatgagggtgaaggcatggctggnagtgcttggcttttaacccttggataaggctaccaaagctgtgaaagggagcttcagatgacctttccagaccttgaaaagttgactttaggttcctagcctttaaatgtactagttttacttaagatgattctacttggccttcttctattctgttagaatagacagatcacagttttgggttaagttgatttcatggtttacattgagtatatcaatatttttcattggtgaatgaagtaagtactatgactgtgtctcctttccttatatacctctccctctgctgtgttaacaacatctctttcatctgcttgactttctgtgtatttatgacaattatttccctgcctcctatggcctctcaatgccattttcctgagggaaagactctcaggtggtcgttcagcagtgggctgtagtctgagctgatgccttcccagggtctctgccgacttacattctagggcacccttcaccagcctcctgggctcccttgtgtcttctatggtcacccttgttttctgcatcccacttgttcctctttctgtgtcattttctcattttggtggagcatattttcagtgaacttcctgagaaagggtacatggaaagtaagttttttgaattcttgcttgtctgaaatgtctttattctcattcataattgataatttgggtatagaatttttgtttaaaacagttttctctcagaatttgagagtattgcctccataactttatttctagtgtggctgtggggaagttcagtgccgtccttactcttgatcctttgaacaggccctttgttttctctctagagactttgagaatcctctctttggcaccagtgttctgaaaattgccacgatgtgtagttctttatttattcattgtgctctgtgtgtggtgggccctttcagtctgaaaatccatttccttcagttctaggaaatttcatctgtatctttgaaaatgtccttccctatatgtttttattctaaaatgactattagttatagtagttctattttggacctcctggatcaattctctgtaatttaagaaaatttcttctatgttttatctttttaaaaatattacatggctaggtgcagtagctcatgcctataatacccacactttgggaggctgaggcaggtggattgcttgagctgaggagttcgagaccagccggggcaacatagcaaaatgccatctctaccaaaaaaaaaaa

SEQ ID NO: 425107 - DNA, 351 bp, Homo sapiens
ctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggggaaaaaatatgtataaccttgtaagtgatttttctcccctttattaaaaaaagattata

SEQ ID NO: 425108 - DNA, 1492 bp, Homo sapiens
tgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccaaatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagcatattca

SEQ ID NO: 425109 - DNA, 1869 bp, Homo sapiens
tgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcactccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgcctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctactttcctttaattgatgtgacatttgtggtaaacacctttcccagggaacctcacaaatcttgagatgctttcccttccccaaatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagcatattca

SEQ ID NO: 425110 - DNA, 1091 bp, Homo sapiens
  misc_feature (1061)..(1061): n is a, c, g, or t
  misc_feature (1082)..(1082): n is a, c, g, or t
tgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcactccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgcctgcagttgctggtctacctgatgccaccctgccacagtgataccctggagcgtctgctgaaggccctgcataaaatcactgagaactgcgaggactcaattggcattgatggacagttggtccaggcaaccgatgacttcactacttggcttggggttggactgtctctganaaagtttgcaagagagagtcnggccttggg

SEQ ID NO: 425111 - DNA, 484 bp, Homo sapiens
tggaagaatggatggatggtagggaaaagaattatatgaatataaacagctcactctttcagggagcttgcctgagatggaaggcagagaataagctcttgaatggctagagttttttttttttttttttttcccctaaaggagagattttatagtccttaccagtataattttctatgtatattatttaccgtttgctaatttaggaatactgccaaaataagatctaggtttatgattttaaataacttaataataattgaattattattatttaaattcaagaagcatttattgaagtgagtattttgttcagcattacactagtttcattagggttttagaagctaaaaagaaactttgtttttatttgtcacctagttggagacatacatcacatacaggaaacaattagaaaaaatacatagtgtctcctttaaacatttggtgaatgaatgacataaatctctaaggtttaaaaaga

SEQ ID NO: 425112 - DNA, 596 bp, Homo sapiens
ctgtactggctataaggaatgctgggcaggcctcgctgccacaccacctcctgagagaagagacggggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcgccatgcactcacacagctatacggctatctccagagattactctgaaaactctgctataaagatgacctggtctaatgccttgatttgttttttgtttgtttgtttttttgagacagggtctcactctcctgg

SEQ ID NO: 425113 - DNA, 358 bp, Homo sapiens
catactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgaaaa

SEQ ID NO: 425114 - DNA, 654 bp, Homo sapiens
tctcatttttattctggcagttcgaagaaacttccccaaatctgacaagtgaatattctcatggttggtggaaaagtgcctgatgtaccagaaagagcactggacttggaaccagaagacctgggtttggggtggtagctggtaggcagctggctgagtgacctgaggctgatgctacgctcaggcacacagattttagtgaagaatgatgaacttgtgaaagttcagctgtttcaggagctccaggtcactggcagagagacggggtcttactatgttgtccaggctggtttcaaactcctggaatcaagcgatcttcctgccttggcctccagaaatgctgggactgcgcctggaatagatacgggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgaaaa

SEQ ID NO: 425115 - DNA, 643 bp, Homo sapiens
ctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgc

SEQ ID NO: 425116 - DNA, 495 bp, Homo sapiens
tctcctgggctcaggtgatcgcccctgagtatctcacactacaggtgcaccctaccatacctggctaatttttttgttttttagtagaaacaagtgaggtcttgtgttgcccaggctggtctcaaactcctggcctcaagtgatcctcctgcctcagcctcccaaagtgctgggattacaagcgttagccactgcacctagcccttatagcctttttttttttttgagttttgtatggttttttattactgcaattgctgctagtgccccactttttaatcattctgcaaagtaggccaaatttaggtagcttgatgatctttattataggtattcagtctctgccatatttagtatcttccctcagatccattattgccgggcatggtggctcacgcctgtaatcccagcattttgggaggctaaggtgggtggatcacttgagcccagtagctcgagagcagcctgggcaacgtggcaagacccatctctaca

SEQ ID NO: 425117 - DNA, 4841 bp, Homo sapiens
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaacctttagtattctgagtattcagtttttagacatagtcatgtagccattgctgaaactgtgctttgcactattaaaggtagggaatgtcctgcttttaaaagtcatccctttaactttaaaataaaaggctaaggtacaataaaacagatgtaaatccatttaccatttttcattca

SEQ ID NO: 425118 - DNA, 3849 bp, Homo sapiens
caagatctttttattgttttattatttcctcattacaaaagcaatgcatgcttattacagaagaatcagaaagtacatccagacaaactactataaggaacactaataatcccacccatgagccaaccatgattttgattttagaaatctattttttaaggcccttttcgatgcagatttaattttttctaaaatggagtctggtcataatattgttttgtaaccagtaaattatttaaataccaattgctggatattgttccaaattagtcccatattgttggatgttttcttggggataaatgcattagtaaaagcaggtaaggagtagaaaaaagtgtaacatgaatgaagtagagtatataattttcagactgtcacattgaacagtttggttttgatcagattttttttgtggtatatcacaccatgagaacaccatcctttttaatagaccaaacttcatatattcatattgttttattccttataaatgagaaacatcacaagccaaactttgtcttactccttaaccttgtaaatttctagtaagtagaatcttataatccccagtatataaaggttctagtttttacattgaaatatattttagaacacatttgaattggtcatgtatgttattttacaagaagccattattaccttactatgttttatcaccttccaagaaaaaaaaaagttgtttctttagcacctgtttatgcacctaacctacctttctaacccttaattttcatgagtctccacagactttgtgctatagcaataatagaggtacttcattataacacatttttcatatactgtcctcaaatacattgaactaaaatttgccttcttttaacttgcttgaaatttccttattttcccttactcattattagtgcttacaaaataaattaagttttaatcttgcttgggttcctttttctgtggcagtgataactggtaccaagatggctagaacaagtaggagatacatgtgttgaaaggattgttgtgttgaagacaaaggatttagttagcctagaaactagattaaaaacaaaaagcaactgataataaatcctgataatgaattatactatcttcaaggacagagaaaagtgacagtttcagctaggacgaacaggaggtgtcagactgctgaagccgactctgaaaggtatgtcatgcatgtctagaatatatggaggcctatcttcactttttatttctacaagtagaaaaaaactaattttcttgcgaatgagagagaatatataacaagatagtgaaaactataaatagctgtcttaggtatatagtctaaaattccatcatcaagagcatttgacttcttacggcgtgtttgcttttgcctattagctggcatggtctttagtactatctttaatatgttgtttcaatttttaattacatgatgtgactcctctttgatcttcagttagcaaactcttgattttgataatatttgggttctctacacttacatactgatagaataattctgtctataatttgggtatattgtgtggtagagtgttttatttttggcttctgtcagtcaagccactgttagagctgaaagttggtagctgtcttgtattcatttgcaaaattgtattgtgtgtattttcagtacatagttttacactgttgattaaatttgtcttttttggggggaaacttgttttttactatgtttttggaatttattgcttaaatcaagagagagaacttaatttttttgtcacttcttgagtttcaaagaaatctcttttggacagttatggtcctcgtttaattacaagcttcattacaagtttgtggctttttttcctgtataacaccaggttctgttatagtatataaaatcattagctagattttccctgattcactttgctagatagccaagtcagtgtttttttgacattgagattttagttttaagctaagtcaatggaatcaggctatcaattaaacactgatagaatgtgagtcagaaacaaaaaagttttatttataaataaactggttttaaagcttgtatctaaattcgtgtattttcaacatctatttagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaacctttagtattctgagtattcagtttttagacatagtcatgtagccattgctgaaactgtgctttgcactattaaaggtagggaatgtcctgcttttaaaagtcatccctttaactttaaaataaaaggctaaggtacaataaaacagatgtaaatccatttaccatttttcattca

SEQ ID NO: 425119 - DNA, 420 bp, Homo sapiens
caatttaaaatatttcatgaggttatcttatttatattgttgtattattccctttaatagaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaa

SEQ ID NO: 425120 - DNA, 559 bp, Homo sapiens
atggaagctagagggagcctttgttcacctatgtttcaaatgactcaatagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaaggtatgtctaaatgttaacactcat

SEQ ID NO: 425121 - DNA, 3303 bp, Homo sapiens
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaa

SEQ ID NO: 425122 - DNA, 3253 bp, Homo sapiens
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaataagtatatatga

SEQ ID NO: 425123 - DNA, 3334 bp, Homo sapiens
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatggtaatcacatactgaacagaatatttataagaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaa

SEQ ID NO: 425124 - DNA, 1362 bp, Homo sapiens
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactgttacagaaattatctcagagattcgggcgcccattgttactgttggtgttaataacgatccagctgtatgaaggaattcagctccagtcaacagcagaaccagaattctcaactgatgatggagatgtattatttgccaggtgtcattctaaacactttacaactgaacttcacaattccacttccattagatgggttttcttatctccacttagctaaagaaactcgcctgccaccc

SEQ ID NO: 425125 - DNA, 355 bp, Homo sapiens
gtaagcgctcccggccccggccgccgcctctcgcccgccccggcccaccctccctcaggggccctccgtggccctcgggctcggcgcaccgtgactccagccttgttcaccttcgcgactcacttcatagggatctgaggttcggagaagtcagggacttacccgaggtcgcctgggcccaggccagaaagcctccgaagcctgggcgtcgttcacacgggccccgccttggcttttctgagccgacacccccagcttctgggcggcgtggaccgttattccttagtccgatcgtgaacgtggagagaaacatttacgaccaccgaggcgatcagacatcaaatattgaaccgca

SEQ ID NO: 425126 - DNA, 699 bp, Homo sapiens
gtctatacaaaagccttgagttctttagaactcagtagccatcttgcaaaagatcttctggttctattgaatgagattctggaggtaaagtagtttctcattactctaaattagtttgtgtttatatttatacatgtagaatttacatggttgtattagattatacatatgttagcatattgtgacttatttgaagtattttcttcataaatttcatataatttagtgtttttaaacaacttgatatgtattggtactattttcaaagattagggaatgcggtgtttacaaaatgttaataatgttttcttttatagcaagtaaaagataggacatgtctgagagctttggagaaaatcaagattcagttagaaaaaggaaataaagaatttggtgaccaagctgaagcagcacaggatgccaccttgactacaactactttccaaaatgaagatggtaatcacatactgaacagaatatttataaggttctgtttttttttttccatctttactgagacatatttttttctactctaacatgtttggttggacatcagaaatgaatgaaattttttttctaattaatcctcttgggaaagagcattactgataaatgtttattctgcttttcaagtgttttttggcatgcatttctcaacatatgaccatctttttaagagttttgcttctttttcca

SEQ ID NO: 425127 - DNA, 905 bp, Homo sapiens
  misc_feature (45)..(45): n is a, c, g, or t
  misc_feature (59)..(59): n is a, c, g, or t
gggctctcttgtctaaagaagatgttaatttgcacaggcgtaggngggtttcccgggtngctagcaccagactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaa

SEQ ID NO: 425128 - DNA, 3941 bp, Homo sapiens
atggaagctagagggagcctttgttcacctatgtttcaaatgactcaatagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaacctttagtattctgagtattcagtttttagacatagtcatgtagccattgctgaaactgtgctttgcactattaaaggtagggaatgtcctgcttttaaaagtcatccctttaactttaaaataaaaggctaaggtacaataaaacagatgtaaatccatttaccatttttcattca

SEQ ID NO: 425129 - DNA, 5763 bp, Homo sapiens
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaaggtatgtcatgcatgtctagaatatatggaggcctatcttcactttttatttctacaagtagaaaaaaactaattttcttgcgaatgagagagaatatataacaagatagtgaaaactataaatagctgtcttaggtatatagtctaaaattccatcatcaagagcatttgacttcttacggcgtgtttgcttttgcctattagctggcatggtctttagtactatctttaatatgttgtttcaatttttaattacatgatgtgactcctctttgatcttcagttagcaaactcttgattttgataatatttgggttctctacacttacatactgatagaataattctgtctataatttgggtatattgtgtggtagagtgttttatttttggcttctgtcagtcaagccactgttagagctgaaagttggtagctgtcttgtattcatttgcaaaattgtattgtgtgtattttcagtacatagttttacactgttgattaaatttgtcttttttggggggaaacttgttttttactatgtttttggaatttattgcttaaatcaagagagagaacttaatttttttgtcacttcttgagtttcaaagaaatctcttttggacagttatggtcctcgtttaattacaagcttcattacaagtttgtggctttttttcctgtataacaccaggttctgttatagtatataaaatcattagctagattttccctgattcactttgctagatagccaagtcagtgtttttttgacattgagattttagttttaagctaagtcaatggaatcaggctatcaattaaacactgatagaatgtgagtcagaaacaaaaaagttttatttataaataaactggttttaaagcttgtatctaaattcgtgtattttcaacatctatttagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaacctttagtattctgagtattcagtttttagacatagtcatgtagccattgctgaaactgtgctttgcactattaaaggtagggaatgtcctgcttttaaaagtcatccctttaactttaaaataaaaggctaaggtacaataaaacagatgtaaatccatttaccatttttcattca

SEQ ID NO: 425130 - DNA, 3383 bp, Homo sapiens
  misc_feature (3329)..(3329): n is a, c, g, or t
  misc_feature (3360)..(3360): n is a, c, g, or t
  misc_feature (3368)..(3368): n is a, c, g, or t
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaaaaaaaaaaaaaaaaaaaaaaatttgnggggggcttgggcccgaaaaagttttttaancccatcgnttgggggcggcgggg

SEQ ID NO: 425131 - DNA, 2821 bp, Homo sapiens
  misc_feature (1)..(1): n is a, c, g, or t
ntcgatgcggcactgactctcttaactaccacggctacaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaacctttagtattctgagtattcagtttttagacatagtcatgtagccattgctgaaactgtgctttgcactattaaaggtagggaatgtcctgcttttaaaagtcatccctttaactttaaaataaaaggctaaggtacaataaaacagatgtaaatccatttaccatttttcattca

SEQ ID NO: 425132 - DNA, 2240 bp, Homo sapiens
  misc_feature (2186)..(2186): n is a, c, g, or t
  misc_feature (2217)..(2217): n is a, c, g, or t
  misc_feature (2225)..(2225): n is a, c, g, or t
cttacggcagtctcgcgggatttccccctctcgcgggaattatttgaacgttcgagcggtaaatactccctggggctgtcatagaagactcctcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaaaaaaaaaaaaaaaaaaaaaaatttgnggggggcttgggcccgaaaaagttttttaancccatcgnttgggggcggcgggg

SEQ ID NO: 425133 - DNA, 3548 bp, Homo sapiens
cgcgggttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgttttatggttttcagtctgatttttccttccctttcacccatttaggtgtgatgtgttggagccaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttccttttt

SEQ ID NO: 425134 - DNA, 3630 bp, Homo sapiens
cgcgggttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgaggctggagtgccgtggcaagatctcggctcactgcaacctctgcctcccagattcaagcgattctcctacctcagcctcccagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgttttatggttttcagtctgatttttccttccctttcacccatttaggtgtgatgtgttggagccaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttccttttt

SEQ ID NO: 425135 - DNA, 3796 bp, Homo sapiens
cagagtggttaatgatagtatggataaatggcatggcttggtccttaaacaatggtagaaatcccttagctcggaatgcacattttcttttcttcctctgattggttctgggtcacctgtgtttacaaattcatagagaacctcatagccactacagtgtgatacagcaaatgtatttctcaaaaaccagcccaatgtaaatggggggaaatattttccgttggttgagaaaggactagtcttgtttaggggaaaaagaaggaaagaggaaaagagagcaaatcttactgagttttttctgagtcatatatttctctgggcacagaagcccttgaggtaaactttattaacccctagacatggagaggtaatttatataagattccacactggtaagtgtcagagatggtatttaaaccaggtttttaggcccaaatgcagaattttttttttttttgagacagtcttactctgtcacccaggctggagtgccgtggcaagatctcggctcactgcaacctctgcctcccagattcaagcgattctcctacctcagcctcccagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgttttatggttttcagtctgatttttccttccctttcacccatttaggtgtgatgtgttggagccaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttccttttt

SEQ ID NO: 425136 - DNA, 3576 bp, Homo sapiens
cgcgggttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgaggctggagtgccgtggcaagatctcggctcactgcaacctctgcctcccagattcaagcgattctcctacctcagcctcccagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaattttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgttttatggttttcagtctgatttttccttccctttcacccatttaggtgtgatgtgttggagccaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttccttttt

SEQ ID NO: 425137 - DNA, 1328 bp, Homo sapiens
cgcgggttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgaggctggagtgccgtggcaagatctcggctcactgcaacctctgcctcccagattcaagcgattctcctacctcagcctcccagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgtgagtaaaattcttagaaatataacatgaagttatttaattcactggaaactctaattactttgtttcattagctaacaattttttagatctggaaaacttaccttctacacagttagtgagcaaaattatagttacaatgcaatagttaaacttcagaactgaactgtcagatgctttaagttatctggaattttgtcagcattacagttttcagagaaagaaacaagataagtttggcatttaactaactgaatatttagagtttgctctgtgcttaggatacattttctaaaactttcacatctacagtcattggatatc

SEQ ID NO: 425138 - DNA, 957 bp, Homo sapiens
cgcgggttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgaggctggagtgccgtggcaagatctcggctcactgcaacctctgcctcccagattcaagcgattctcctacctcagcctcccagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattaccaattccaaacttgtaaaaaagtaacctcgccagcgcacgtctgggatcctct

SEQ ID NO: 425139 - DNA, 590 bp, Homo sapiens
cagagtggttaatgatagtatggataaatggcatggcttggtccttaaacaatggtagaaatcccttagctcggaatgcacattttcttttcttcctctgattggttctgggtcacctgtgtttacaaattcatagagaacctcatagccactacagtgtgatacagcaaatgtatttctcaaaaaccagcccaatgtaaatggggggaaatattttccgttggttgagaaaggactagtcttgtttaggggaaaaagaaggaaagaggaaaagagagcaaatcttactgagttttttctgagtcatatatttctctgggcacagaagcccttgaggtaaactttattaacccctagacatggagaggtaatttatataagattccacactggtaagtgtcagagatggtatttaaaccaggtttttaggcccaaatgcagaattttttttttttttgagacagtcttactctgtcacccaggctggagtgccgtggcaagatctcggctcactgcaacctctgcctcccagattcaagcgattctcctacctcagcctcccaggtagctgaaattatagacacatgcca

SEQ ID NO: 425140 - DNA, 660 bp, Homo sapiens
tgactgtcaccctggctcccagaactctgttttcttgggaatacttagctcccttctcccagtgtctactctaagggcactgaaaatgccctggaagcaggagagagggactggtagtctcaggaaaattcctgtgcctgttggtgtggatgtcacctcgtgtctgtattaacaggaaacagtaccaaagaggcagctcttggctcctgcagaaggacgtgtttgcttatttttcattcacaagatcatgaagggtgcttcatgactgcttaggagctcagatgggcctgcgccgtgccccccggccccggcagctcccctccagcctgtgtcagcccagcatggcgaacagaactgctctcaacctccctgggcattgggcaggctggggtgacccctggtgggcttggggaatgtgttgagcaacctcagcacccctgtcttacagtttcttctcgtcaacagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggaggaa

SEQ ID NO: 425141 - DNA, 5397 bp, Homo sapiens
ggcggccaggtggaggacctgagcaagcagctcaagcgtgtggacggccaggtgcagggcatcgccacgcacgtgcagcacttctcccaggccagcgggcttgacctggccgcgctagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcgggctcagaaacacttatgggattttctaagcacggagggttcacttccttaacatcacctgaagggactctaagcggagactctaccaagcaaccaagtattgagcaggctctggattctgccagtggtcttggcccggatcggactgcatcaggatctggtggcacagcacacccctctgatggggtttccagtagggaacaaagcaaggtcccctctggtactgggagacagcagcagccgagggcccgtgatgaagctggcgtgccacgactccatcagtcttctacattccaattcaaatcagactcagatcgtcacaggagtagagagaagcttacctcgacacaaccaagaagaaatgcacgtcctggtccagttcaacaggacttacccttggccagagaccagcccagtagtgtgcccgctagccagagtcaggtccatctaaggccagatcgtcgtgggttagaaccaactggcatgaatcagcctggattagtgcctgctagcacttacccacatggtgtggtacccctcagcatgggtcagcttggtgtgccaccacctgaaatggatgatcgggaattgataccatttgtcgtggatgagcaacgtatgttgccaccatcagtacctggcagagaccagcaaggattggaactacctagcacagaccaacatggtctggtttcagtcagtgcatatcagcatggtatgacatttcctggcacagaccaacgcagtatggaaccacttggcatggatcagcgtggatgtgtaatatcaggcatgggtcagcaaggactagtaccccctggtatagaccagcaaggattgacattgcctgtcgtcgatcaacatggcctggttctaccttttacagaccagcatggtttggtatcacctggtttgatgccaattagtgcagatcagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggcagatccacatggcctggtacaacctggtgcctatcctcttggtttggtacaacctggtgcatatttgcatgatttatctcaatctgggacatatccacgtggtctggtgcagccaggaatggatcagtatggtttgagacaacctggtgcatatcagccaggcttgatagcaccaggcacaaagcttcgtggctcttcaacattccaggcagattctacaggttttatatcagtacgtccatatcaacatggtatggtacctcctggcagagaacaatacggccaggtgtcaccactcctagccagtcaaggtttggcatcacctggtatagatcgaaggagtttggtaccaccagaaacttatcagcaaggtttgatgcatcctggcacagaccagcacagcccaataccactgagtacaggtttgggatctacacacccagatcaacagcatgtggcatcacctggcccaggtgagcatgaccaggtatacccagatgcagctcagcatggccatgctttctctctctttgacagtcatgattcaatgtatcctggttatcgtggcccagggtatctaagtgctgatcagcatggccaggaaggtttggatccaaatagaacacgagcctcggaccgacatggaattcctgcccagaaggccccaggccaagatgtcactcttttcaggagtccagactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatggtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaagctggaccgcctggagctggacccagtgaagcagttgctggaggatcggtggaaatcgctgcgacagcagctcagggagcgccccccactctaccaggcagacgaggcggctgccatgcggaggcagctcctggcacatttccactgcctctcatgtgaccggcccttggagacacctgtgactggacatgccatccccgtgacccccgcgggtccaggcctacctgggcaccattccatccgcccctacacggtgtttgaactggagcaggtccggcagcatagccgcaacctcaagctgggcagcgccttccctcggggtgacctggcgcagatggagcagagcgtggggcgcctgcgctccatgcactccaagatgctgatgaacattgagaaggtgcagatccacttcgggggctccaccaaggccagcagccagataatccgcgagctgctgcacgcccagtgcctgggctccccctgctacaaacgggtgacagatatggctgattacacctactcaactgtgccccggcgctgcgggggcagccacaccctcacctacccctaccaccgcagccgcccgcagcaccttccccggggcctgtatcctactgaagagatccagattgccatgaagcatgatgaggtggacatcttgggcctggatggccacatttacaagggacggatggacacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggaggaaacaacaacataaaaacaacaaacaaaaaaacaaaaact

SEQ ID NO: 425142 - DNA, 428 bp, Homo sapiens
tcccaaagcaactcaggaccaggtcttggaaatgcaaaaataagcttcttagactgtgtccccagtcggaggctgaaggagacaacttctgacggcccctctgagctctctctttgcagtgcccagtcctaccgcccagaagcctcccaggacagaggcatagcccgggactccctagacaaaatccattggaggggggtggagggtgagagacctccagctgtgtctgcatccccctgcgtccctgatggcccaggctctgcatgggtctggcctgagtgtggagtctggcagtctctcatcgtgcaccacagagtcaccgtggctgacatagaaaaggagctggccgagttgagggagagccaagacaggggcaaggctgccatggaaaattctgtctctgaagcctccctttacctgcaggacca

SEQ ID NO: 425143 - DNA, 5359 bp, Homo sapiens
ggcggccaggtggaggacctgagcaagcagctcaagcgtgtggacggccaggtgcagggcatcgccacgcacgtgcagcacttctcccaggccagcgggcttgacctggccgcgctagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcgggctcagaaacacttatgggattttctaagcacggagggttcacttccttaacatcacctgaagggactctaagcggagactctaccaagcaaccaagtattgagcaggctctggattctgccagtggtcttggcccggatcggactgcatcaggatctggtggcacagcacacccctctgatggggtttccagtagggaacaaagcaaggtcccctctggtactgggagacagcagcagccgagggcccgtgatgaagctggcgtgccacgactccatcagtcttctacattccaattcaaatcagactcagatcgtcacaggagtagagagaagcttacctcgacacaaccaagaagaaatgcacgtcctggtccagttcaacaggacttacccttggccagagaccagcccagtagtgtgcccgctagccagagtcaggtccatctaaggccagatcgtcgtgggttagaaccaactggcatgaatcagcctggattagtgcctgctagcacttacccacatggtgtggtacccctcagcatgggtcagcttggtgtgccaccacctgaaatggatgatcgggaattgataccatttgtcgtggatgagcaacgtatgttgccaccatcagtacctggcagagaccagcaaggattggaactacctagcacagaccaacatggtctggtttcagtcagtgcatatcagcatggtatgacatttcctggcacagaccaacgcagtatggaaccacttggcatggatcagcgtggatgtgtaatatcaggcatgggtcagcaaggactagtaccccctggtatagaccagcaaggattgacattgcctgtcgtcgatcaacatggcctggttctaccttttacagaccagcatggtttggtatcacctggtttgatgccaattagtgcagatcagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggcagatccacatggcctggtacaacctggtgcctatcctcttggtttggtacaacctggtgcatatttgcatgatttatctcaatctgggacatatccacgtggtctggtgcagccaggaatggatcagtatggtttgagacaacctggtgcatatcagccaggcttgatagcaccaggcacaaagcttcgtggctcttcaacattccaggcagattctacaggttttatatcagtacgtccatatcaacatggtatggtacctcctggcagagaacaatacggccaggtgtcaccactcctagccagtcaaggtttggcatcacctggtatagatcgaaggagtttggtaccaccagaaacttatcagcaaggtttgatgcatcctggcacagaccagcacagcccaataccactgagtacaggtttgggatctacacacccagatcaacagcatgtggcatcacctggcccaggtgagcatgaccaggtatacccagatgcagctcagcatggccatgctttctctctctttgacagtcatgattcaatgtatcctggttatcgtggcccagggtatctaagtgctgatcagcatggccaggaaggtttggatccaaatagaacacgagcctcggaccgacatggaattcctgcccagaaggccccaggccaagatgtcactcttttcaggagtccagactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatggtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaagctggaccgcctggagctggacccagtgaagcagttgctggaggatcggtggaaatcgctgcgacagcagctcagggagcgccccccactctaccaggcagacgaggcggctgccatgcggaggcagctcctggcacatttccactgcctctcatgtgaccggcccttggagacacctgtgactggacatgccatccccgtgacccccgcgggtccaggcctacctgggcaccattccatccgcccctacacggtgtttgaactggagcaggtccggcagcatagccgcaacctcaagctgggcagcgccttccctcggggtgacctggcgcagatggagcagagcgtggggcgcctgcgctccatgcactccaagatgctgatgaacattgagaaggtgcagatccacttcgggggctccaccaaggccagcagccagataatccgcgagctgctgcacgcccagtgcctgggctccccctgctacaaacgggtgacagatatggctgattacacctactcaactgtgccccggcgctgcgggggcagccacaccctcacctacccctaccaccgcagccgcccgcagcaccttccccggggcctgtatcctactgaagagatccagattgccatgaagcatgatgaggtggacatcttgggcctggatggccacatttacaagggacggatggacacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggaggaa

SEQ ID NO: 425144 - DNA, 3553 bp, Homo sapiens
ggcggccaggtggaggacctgagcaagcagctcaagcgtgtggacggccaggtgcagggcatcgccacgcacgtgcagcacttctcccaggccagcgggcttgacctggccgcgctagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcgggctcagaaacacttatgggattttctaagcacggagggttcacttccttaacatcacctgaagggactctaagcggagactctaccaagcaaccaagtattgagcaggctctggattctgccagtggtcttggcccggatcggactgcatcaggatctggtggcacagcacacccctctgatggggtttccagtagggaacaaagcaaggtcccctctggtactgggagacagcagcagccgagggcccgtgatgaagctggcgtgccacgactccatcagtcttctacattccaattcaaatcagactcagatcgtcacaggagtagagagaagcttacctcgacacaaccaagaagaaatgcacgtcctggtccagttcaacaggacttacccttggccagagaccagcccagtagtgtgcccgctagccagagtcaggtccatctaaggccagatcgtcgtgggttagaaccaactggcatgaatcagcctggattagtgcctgctagcacttacccacatggtgtggtacccctcagcatgggtcagcttggtgtgccaccacctgaaatggatgatcgggaattgataccatttgtcgtggatgagcaacgtatgttgccaccatcagtacctggcagagaccagcaaggattggaactacctagcacagaccaacatggtctggtttcagtcagtgcatatcagcatggtatgacatttcctggcacagaccaacgcagtatggaaccacttggcatggatcagcgtggatgtgtaatatcaggcatgggtcagcaaggactagtaccccctggtatagaccagcaaggattgacattgcctgtcgtcgatcaacatggcctggttctaccttttacagaccagcatggtttggtatcacctggtttgatgccaattagtgcagatcagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggcagatccacatggcctggtacaacctggtgcctatcctcttggtttggtacaacctggtgcatatttgcatgatttatctcaatctgggacatatccacgtggtctggtgcagccaggaatggatcagtatggtttgagacaacctggtgcatatcagccaggcttgatagcaccaggcacaaagcttcgtggctcttcaacattccaggcagattctacaggttttatatcagtacgtccatatcaacatggtatggtacctcctggcagagaacaatacggccaggtgtcaccactcctagccagtcaaggtttggcatcacctggtatagatcgaaggagtttggtaccaccagaaacttatcagcaaggtttgatgcatcctggcacagaccagcacagcccaataccactgagtacaggtttgggatctacacacccagatcaacagcatgtggcatcacctggcccaggtgagcatgaccaggtatacccagatgcagctcagcatggccatgctttctctctctttgacagtcatgattcaatgtatcctggttatcgtggcccagggtatctaagtgctgatcagcatggccaggaaggtttggatccaaatagaacacgagcctcggaccgacatggaattcctgcccagaaggccccaggccaagatgtcactcttttcaggagtccagactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatgggtgggtgccgcttgccgatagaggagaaaccattgtctctgttttcagttggtttcatccttttcttcccctggcctcaactcctggctgctacacatctccctgagtccctgaaaacagcatgtcattcagagcatgtcccacagccttcagagtcca

SEQ ID NO: 425145 - DNA, 1315 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425146 - DNA, 1721 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgcc

SEQ ID NO: 425147 - DNA, 845 bp, Homo sapiens
  misc_feature (48)..(48): n is a, c, g, or t
ccattcacattcatattcaattaactccatctcaatatatttcattanatttaattgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgcc

SEQ ID NO: 425148 - DNA, 1134 bp, Homo sapiens
ttggggagattggctcagatgatttatgaactcggtaagagctgaacattgactaacggatcataaggtaattgaggaacattgtaagtcaaacttcaatttagttctaccagcaggaaggatttgtttacaacctgcaatagtactcttttagatgatgtgaagctttgaaaatattgaaataagtgattgctcacctctccccccaggtatataggaattgattgtgtatttgggggatcctaccctaaactgagaattagagactagtgaagcatgggattgtgtggataatgtttcttcatgtttatgtacttaaataaaccagcaaaatatacgtcgagaatgtatctaaattatttttttgtcctaagaagttgaggtgcaggctggctgaatttttttttttttttttagtagctgaattcttttgagactgttttcagtgttccccagagagctctgcctaaaataccttaacttccgcaaataagtaaagtgaaaagtcctgattccttgcctctttattttgcgctggtactacaataatataatggttactttatatcaaacattatgacaccttgacctttggaatattagaggtctcacaataacttcggagccaccttgagaaacgagcagatatgaatcagagaggacccaagggccgttggagaggcactgctccctctgagaatgcccaagaggggtgggggcgggggggggcgggtaaaggcttagaaataaagaggtgaagtgaaccttttgcttcaaatattctctatttctatttttttggtggtacttttcttctgattctctctgatatgttcatagatgctggttggcttaattggtattcaaaatttggtactaataaccctgagtgaaaaaataatttggagactagattcaagggtttattaacagacttctctgtgtgtttcttgttgctttggttggttcttcatctacctttctctgtttaaatataaaaatcaggtggaaaatatggaggactttgattaatcaaactagttaagagatcatttagtggtgcgtctacacaatagtcatttctgttttttttctttactttcaacctttctttaggctaaagagaagttcgtc

SEQ ID NO: 425149 - DNA, 945 bp, Homo sapiens
tactctacgctttctggtggtctgggagtttcgaaatctttaatgttgtgatgacaacgcttacccgcgcatcccttcttgatcgttcttaggtcttctcaggggcctggaagtgtagacctaggcttgggattcaaggaggtcttggttaaaacggcaagatgtaaataagattgtgacgcatccattttgttgaaagaaaaaaccaggaatttggccttttgatggaggaacttagaagaactttgtaattttgtaaggttgtggaaaatccgaggcaaagttaaattgcctggtgtgatttgactttaacttcgaataggctttttaaagtttcatctctttggagattgttcaacttcacgagttcactgcagtgaaaacgccaagactgtctcccacaaatttaatattaatgaagaaaggcaagccaattatatctgttgtccggagttagttgtacagccctttctttgaatggggatctggggatgcagaggagcataatgagccttttataattacaaacatgctcttctctagctcttaaggttatgcctaacgctcatttgctcttggctaaaataactgagaaaaaaagtgagtagtaaaaaaatgctggaagtctgaaaatggtttagacagaacttcattcctgaagttttagtctgtagccagattttaattctggcctgttttggtttttagatgatagatcttttagtgtgtcaacaggaatgtaaagtttgtattaaacatctagggtgatcacctgccatgctattaagtcagcatggtataattaaaagttacatatgtaggttcagagcctcttagcacagtgttacattgtaagctcttggagggcaggaatgagattctagtccttacggaaatggagtttgggcttctatccctagcattcattctagtgccatgcacgtg

SEQ ID NO: 425150 - DNA, 2279 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctctattgtttgagagagttattaaccatcactaaataagcccctgctggtgctattcatcctaagacatgttacatgcagtttcaagtaagcagcttggaatgggctgcttcagttggagggagggggtgtaatatttgaaacgagtgtgtgtcttcaccatctccagcattttaaatatatggcgttttttttttttttggttatcagttgtaatacaggtctcatacctcagtttcagatgttatagatggttacctctttgagctgccctgtcaccccagcaaccctaaaagagaattttgtacattctgtatcccacagatttggtcagccatttcaaaattccctccagtttggtaaaaaaaaaatctgtcttcggtttcagctggatgatgaatccttgtttttcaggtggctccaaaaagaatgttgcatgtgttcagaccatcctgagcagagccaccaaatttagtgacagtgtctagccatgttagcaataatgttaacagaagcttttgtttaaattacaaaatacatttatactatttactaaaa

SEQ ID NO: 425151 - DNA, 2110 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccaaaaaaaagaaaaaaaaaaaacaaaaacaaaacactgtgtgttggcgcgcgcgccgtgggccccgtgggaaaaaagcttccttgtgaacaccatattcgttgtgggccgcgcggggggcccccaatttgtggttaatggtgaaccgtgggtctcaaagcgggtcccccagagaggagaactcgcgggcacagattgaaacataggtgttgtggggaattttcttctccgacattataaaaaaaggcgcgggggggaaaacagcggaagagtggtttggtgaaacaaattctcacaaagatgggagttctggaagggctacataggcgggactctctaatacagggggggagttcaaagaggaatcgccgaaatattaaaaattaaggcc

SEQ ID NO: 425152 - DNA, 2088 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctctattgtttgagagagttattaaccatcactaaataagcccctgctggtgctattcatcctaagacatgttacatgcagtttcaagtaagcagcttggaatgggctgcttcagttggagggagggggtgtaatatttgaaacgagtgtgtgtcttcaccatctccagcattttaaatatatggcgttttttttttttttggttatcagttgtaatacaggtctcatacctcagtttcagatgttatagatggttacctctttagccggtgatgtcaccccatatcctcttaaaggaaaattttgatcatttttgaccaaaaaattttgtcggacattttaaaaatccctccaaattagtaaaaga

SEQ ID NO: 425153 - DNA, 2485 bp, Homo sapiens
  misc_feature (822)..(822): n is a, c, g, or t
ttggggagattggctcagatgatttatgaactcggtaagagctgaacattgactaacggatcataaggtaattgaggaacattgtaagtcaaacttcaatttagttctaccagcaggaaggatttgtttacaacctgcaatagtactcttttagatgatgtgaagctttgaaaatattgaaataagtgattgctcacctctccccccaggtatataggaattgattgtgtatttgggggatcctaccctaaactgagaattagagactagtgaagcatgggattgtgtggataatgtttcttcatgtttatgtacttaaataaaccagcaaaatatacgtcgagaatgtatctaaattatttttttgtcctaagaagttgaggtgcaggctggctgaatttttttttttttttttagtagctgaattcttttgagactgttttcagtgttccccagagagctctgcctaaaataccttaacttccgcaaataagtaaagtgaaaagtcctgattccttgcctctttattttgcgctggtactacaataatataatggttactttatatcaaacattatgacaccttgacctttggaatattagaggtctcacaataacttcggagccaccttgagaaacgagcagatatgaatcagagaggacccaagggccgttggagaggcactgctccctctgggttctgactaggaattttcctccgttcatgtttaaccgcgacaggcacagactctgggtgaaaagaaagaactttgtgctttggctgcagcgctgcgagtataaagggatgagtgggtgcacggngaggctatgaagaaaaacacaaatggaagtatcaaccttactggtagagtgcatttctaattctgctttcacagtggtaacgtcttgttctctaaaacgtgtcttcctgtgaacatagctgtctgggtcaggactgctctagagaaatgctatcatgtgtcatgaaagttatacttaactagggttaggccagacaaatactcagtgtcattttaaagaatcagagtgctataattttagctattcccttttatttctgatgtcattttgttcataggtttctagaccaactggggagattcccgttaaaaagtatgtatactgaaacatagattttagatcatctagtttccaaaattgtgtaataggattttggcatcaagtatgtgaacagtttatattctgtcatagtacatatccatttttggtatcatttcatttgtttccctttaagaaataaaacctatagtctccagttatctacactgaaacttcctttttgaaataaaaatttgctttttttttctaacagtaatggtaacaggtatacttttgatcccacctgtttttactttgctcactttattttcttttttagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425154 - DNA, 1965 bp, Homo sapiens
  misc_feature (822)..(822): n is a, c, g, or t
ttggggagattggctcagatgatttatgaactcggtaagagctgaacattgactaacggatcataaggtaattgaggaacattgtaagtcaaacttcaatttagttctaccagcaggaaggatttgtttacaacctgcaatagtactcttttagatgatgtgaagctttgaaaatattgaaataagtgattgctcacctctccccccaggtatataggaattgattgtgtatttgggggatcctaccctaaactgagaattagagactagtgaagcatgggattgtgtggataatgtttcttcatgtttatgtacttaaataaaccagcaaaatatacgtcgagaatgtatctaaattatttttttgtcctaagaagttgaggtgcaggctggctgaatttttttttttttttttagtagctgaattcttttgagactgttttcagtgttccccagagagctctgcctaaaataccttaacttccgcaaataagtaaagtgaaaagtcctgattccttgcctctttattttgcgctggtactacaataatataatggttactttatatcaaacattatgacaccttgacctttggaatattagaggtctcacaataacttcggagccaccttgagaaacgagcagatatgaatcagagaggacccaagggccgttggagaggcactgctccctctgggttctgactaggaattttcctccgttcatgtttaaccgcgacaggcacagactctgggtgaaaagaaagaactttgtgctttggctgcagcgctgcgagtataaagggatgagtgggtgcacggngaggctatgaagaaaaacacaaatggaagtatcaaccttactggtttctagaccaactggggagattcccgttaaaaatgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425155 - DNA, 1490 bp, Homo sapiens
tactctacgctttctggtggtctgggagtttcgaaatctttaatgttgtgatgacaacgcttacccgcgcatcccttcttgatcgttcttaggtcttctcaggggcctggaagtgtagacctaggcttgggattcaaggaggtcttggttaaaacggcaagatgtaaataagattgtgacgcatccattttgttgaaagaaaaaaccaggaatttggccttttgatggaggaacttagaagaactttgtaattttgtaaggttgtggaaaatccgaggcaaagttaaattgcctggtgtgatttgactttaacttcgaataggctttttaaagtttcatctctttggagattgttcaacttcacgagttcactgcagtgaaaacgccaagactgtctcccacaaatttaatattaatgaagaaagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425156 - DNA, 1046 bp, Homo sapiens
aaaaatgtattgataaaagttgtatttgagctagtgagaacaatatgttctcctcattttacagttttttgtagctgtaaactttgttcttgtcttcaggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425157 - DNA, 1201 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425158 - DNA, 1435 bp, Homo sapiens
gctatttaaatattttataaatagttatcttacatagtgtgtccagtaattcccagtatctgaaaacctcaggggttgtaaatattgttagttttttggttttgattgattggctgttaccaatgatagaaatgaatcagaaatctatttaatagtaatggcataatggtcatttgtaacgttagcctcacagtggttctgaagctgctatattcaggtttagggcacaatatttaggcttcacaggatcggtttcagttgtatgtttgaggtgcttccctcagacccactggtcaaaggctcccaagcttagagttggaacagggcaggtgttctgtcccaaatgtttggcccaggtgattcagttaaaaaataccattatctcacctcgttctatagcttgctaataagatgatgttgaagttgttgagacacaaagacttaggcagcatgaaaatggaggaaggtgcatctcttgcaggaaatttatgagcttagactcataaagctgagggaaggtaaatttcctactgtcataaagaatctgtttaggacagctccatatcccaacatcttcttgtatattttttttcctctttagggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425159 - DNA, 1278 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacgtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425160 - DNA, 1912 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctctattgtttgagagagttattaaccatcactaaataagcccctgctggtgctattcatcctaagacatgttacatgcagtttcaagtaagcagcttggaatgggctgcttcagttggagggagggggtgtaatatttgaaacgagtgtgtgtcttcaccatctccagcattttaaatatatggcgttttttttttttttggttatcagttgtaatacaggtctcatacctcagtttcagatgttatagatggttacctctttgagctgccctgtcaccccagcaaccctaaaagagaattttgtacattctgtatcccacagatttggtcagccatttcaaaattccctccagtttggtaaaaaaaaaatctgtcttcggtttcagctggatgatgaatccttgtttttcaggtggctccaaaaagaatgttgcatgtgttcagaccatcctgagcagagccaccaaatttagtgacagtgtctagccatgttagcaataatgttaacagaagcttttgtttaaattacaaaatacatttatactatttactaaaa

SEQ ID NO: 425161 - DNA, 1261 bp, Homo sapiens
ggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaaagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctca

SEQ ID NO: 425162 - DNA, 605 bp, Homo sapiens
gggggcgggggggggcgggtaaaggcttagaaataaagaggtgaagtgaaccttttgcttcaaatattctctatttctatttttttggtggtacttttcttctgattctctctgatatgttcatagatgctggttggcttaattggtattcaaaatttggtactaataaccctgagtgaaaaaataatttggagactagattcaagggtttattaacagacttctctgtgtgtttcttgttgctttggttggttcttcatctacctttctctgtttaaatataaaaatcaggtggaaaatatggaggactttgattaatcaaactagttaagagatcatttagtggtgcgtctacacaatagtcatttctgttttttttctttactttcaacctttctttaggctaaagagaagttcgtctgttttcttttctttttccactcatgtgcacaatgaagtttttagggggttgcaagtgtatagttcatttattttctttcttgtttaacaattaattacactattccaggctatgaagaaaaacacaaatggaagtatcaaccttactggtagagtgcatttctaattctgctttcacagtggta

SEQ ID NO: 425163 - DNA, 506 bp, Homo sapiens
cacagttttgagcaaaatgccttgtacgaattggtcaatgaacaactagtaaataattatgtgaatatttactgaattatatggatcctatgaataattactgaataattcatgtgattgcttttattggcagtgctgaaaactcatccccgtgtgacctcaagtaagccatgtaactctgtgaacctgcagttttatcatttttaaaataaagaaacatgacagattttcattatgacacagaatgtcaggtctcccagatgccagaaaatacatttacttaaagccgttgatacgtcttaaagcggtttccttacagtgtcattggaggacagtgtggagtgcagagagacatgctttgaaatgggattgatccagtcctccttccttcactaccacatgaatgctgggcagcccagggtcaacccaccgcaccctcaactcagacggttacctggcacgctggccacagtctacctcactcttatcagagtctgagctactgg

SEQ ID NO: 425164 - DNA, 1264 bp, Homo sapiens
cgcccgccgcccccacaccatcggctagtcgagccccctgttattgggctgggtggcggttgagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggaagatggccaatctttcctaagctgctcaccttacaagaaaacgaatcgtactgctaagaattcaaacttcagcagtcatggggagccttggaaggagcccgaatcactgatggaattggacagtgcatggagatggttcagcaggacaagggtaagtgcaggggcaagtccaggtcatactgagagacaacgagtggcgctgacagagacagacaaagataaaatcaaaagtttgtgcttcatcttcaaaaactcaaactaataacaaacttggccttatgagaaataataagtatttttctatttacatgagaatttaatctcaaaacaggaatcagaaacatattaagtccagggcataaaacctaaaccactgctcatatttattctttctaaatagagcaaagtgtaaaatcttctccataaaatgcacattgtgcttatgaaaaggccagtcttagtgagaatcattggtattccatagaagagtgaattaaacacagccaagggaagacccaagtctcatacttctcttgtatattccagagttccaggggaattccaggtgatagaggtgatctcccatactgttaaagcaaggttgcagacacttgggaattttggtcccagtactctaggaggtcacacctctgtcctggaaaatactacaggaatgtatactcttcctatgactcattctggtcattcttccagcatcacaaaaaccaaaaaaaaaaaa

SEQ ID NO: 425165 - DNA, 1568 bp, Homo sapiens
ggctgcaggcgcaggcgcaggcgaggggctgggtggcggttgagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacagtgtccacagatcagaagttcaggcctggattctctgggtcttcttctcagggcctcacaggctgaaattaggctgggtttctttctggaggttctggggaagaacttcctctcaagtttcctcaggttgtcagctgagttcagttccttgtgactgtaggactgagatctctgttttcttgctggctgtcagccaggggcctctcgctgctcctagaggcctcccatgttcccactgcatgcttcctccagccagcagaggaggatcgccctgcatggaaaccctcctgcacttcacatctctccaggaagtcctcagtccctccaaggaactcacgttcactaggtcaagctcatcagataatctgtctatcttaaattggaccgatttgggatctcgattacatctgttaacttgtttttgccataaattgtaacacaatcacaggagtgacatctcctcagtagctttgtctacactcaggaggaagtgattatataagagcaaagatcactgggggtcatcttaggattctgtctaccataatattataaagacacagtaattaaaagagtataacagatttctgcttctgtctgttagaataaatcatatcagactaaccctgcctccataaacaaacgtaaaattgttttcagcagtgtacaacaggcagtccaagagaaaacttaagggggaagccccatgatttcctagttgtttggggagaatttctcagcagctgcatagtgagctagagtccactcagggcagggcagctcactgagctgagaaggcagagatcagagttcaagacggctgaagcaactgcaatctgcagggcagggcaccagtgaggagacagctgatcaaaggtgcagctctcaaagtctatgtggggttccatgtgcatacttatcaaggagtggactctacctgcacaaggaaaagactaacagatttaacagaggggtggctgctatgaaattgagtttggaccagaggtacttgaggtggaggagggttggggaatgtatgatggagtttctgccatccatggtggga

SEQ ID NO: 425166 - DNA, 1049 bp, Homo sapiens
cgcccgccgcccccacaccatcggctagtcgagccccctgttattgggctgggtggcggttgagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggaagatggccaatctttcctaagctgctcaccttacaagaaaacgaatcgtactgctaagaattcaaacttcagcagtcatggggagccttggaaggagcccgaatcactgatggaattggacagtgcatggagatggttcagcaggacaaggtgctgaaaactcatccccgtgtgacctcaagtaagccatgtaactctgtgaacctgcagttttatcatttttaaaataaagaaacatgacagattttcattatgacacagaatgtcaggtctcccagatgccagaaaatacatttacttaaagccgttgatacgtcttaaagcggtttccttacagtgtcattggaggacagtgtggagtgcagagagacatgctttgaaatgggattgatccagtcctccttccttcactaccacatgaatgctgggcagcccagggtcaacccaccgcaccctcaactcagacggttacctggcacgctggccacagtctacctcactcttatcagagtctgagctactgg

SEQ ID NO: 425167 - DNA, 1514 bp, Homo sapiens
ggctgcaggcgcaggcgcaggcgaggggctgggtggcggttgagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacagtgtccacagatcagaagttcaggcctggattctctgggtcttcttctcagggcctcacaggctgaaattaggctgggtttctttctggaggttctggggaagaacttcctctcaagtttcctcaggttgtcagctgagttcagttccttgtgactgtaggactgagatctctgttttcttgctggctgtcagccaggggcctctcgctgctcctagaggcctcccatgttcccactgcatgcttcctccagccagcagaggaggatcgccctgcatggaaaccctcctgcacttcacatctctccaggaagtcctcagtccctccaaggaactcacgttcactaggtcaagctcatcagataatctgtctatcttaaattggaccgatttgggatctcgattacatctgttaacttgtttttgccataaattgtaacacaatcacaggagtgacatctcctcagtagctttgtctacactcaggaggaagtgattatataagagcaaagatcactgggggtcatcttaggattctgtctaccataatattataaagacacagtaattaaaagagtataacagatttctgcttctgtctgttagaataaatcatatcagactaaccctgcctccataaacaaacgtaaaattgttttcagcagtgtacaacaggcagtccaagagacagctgcatagtgagctagagtccactcagggcagggcagctcactgagctgagaaggcagagatcagagttcaagacggctgaagcaactgcaatctgcagggcagggcaccagtgaggagacagctgatcaaaggtgcagctctcaaagtctatgtggggttccatgtgcatacttatcaaggagtggactctacctgcacaaggaaaagactaacagatttaacagaggggtggctgctatgaaattgagtttggaccagaggtacttgaggtggaggagggttggggaatgtatgatggagtttctgccatccatggtggga

SEQ ID NO: 425168 - DNA, 1365 bp, Homo sapiens
agcggagctgggtcgaggcgcggccgtggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacagtgtccacagatcagaagttcaggcctggattctctgggtcttcttctcagggcctcacaggctgaaattaggctgggtttctttctggaggttctggggaagaacttcctctcaagtttcctcaggttgtcagctgagttcagttccttgtgactgtaggactgagatctctgttttcttgctggctgtcagccaggggcctctcgctgctcctagaggcctcccatgttcccactgcatgcttcctccagccagcagaggaggatcgccctgcatggaaaccctcctgcacttcacatctctccaggaagtcctcagtccctccaaggaactcacgttcactaggtcaagctcatcagataatctgtctatcttaaattggaccgatttgggatctcgattacatctgttaacttgtttttgccataaattgtaacacaatcacaggagtgacatctcctcagtagctttgtctacactcaggaggaagtgattatataagagcaaagatcactgggggtcatcttaggattctgtctaccataatattataaagacacagtaattaaaagagtataacagatttctgcttctgtctgttagaataaatcatatcagactaaccctgcctccataaacaaacgtaaaattgttttcagcagtgtacaacaggcagtccaagagaaaacttaagggggaagccccatgatttcctagttgtttggggagaatttctcagcagctgcatagtgagctagagtccactcagggcagggcagctcactgagctgagaaggcagagatcagagttcaagacggctgaagcaactgcaatctgcagggcagggcaccagtgaggagacagctgatcaaaggtgcagctctcaaagtctatgtggggttccatgtgcatacttatcaaggagtggactctacctgcacaaggaaaagactaacagatttaacagaggggtggctgctatgaaattgagtttggaccagaggtacttgaggtggaggagggttggggaatgtatgatggagtttctgccatccatggtggga

SEQ ID NO: 425169 - DNA, 1202 bp, Homo sapiens
catccctctcccaccgtttccttcttgtccccactccaaagccttctccattttatttgtattaattttctattgctgcatactaaattactgcaagcattagcggcgtaaaataagaatgatttattttcttgcagtgtccacagatcagaagttcaggcctggattctctgggtcttcttctcagggcctcacaggctgaaattaggctgggtttctttctggaggttctggggaagaacttcctctcaagtttcctcaggttgtcagctgagttcagttccttgtgactgtaggactgagatctctgttttcttgctggctgtcagccaggggcctctcgctgctcctagaggcctcccatgttcccactgcatgcttcctccagccagcagaggaggatcgccctgcatggaaaccctcctgcacttcacatctctccaggaagtcctcagtccctccaaggaactcacgttcactaggtcaagctcatcagataatctgtctatcttaaattggaccgatttgggatctcgattacatctgttaacttgtttttgccataaattgtaacacaatcacaggagtgacatctcctcagtagctttgtctacactcaggaggaagtgattatataagagcaaagatcactgggggtcatcttaggattctgtctaccataatattataaagacacagtaattaaaagagtataacagatttctgcttctgtctgttagaataaatcatatcagactaaccctgcctccataaacaaacgtaaaattgttttcagcagtgtacaacaggcagtccaagagaaaacttaagggggaagccccatgatttcctagttgtttggggagaatttctcagcagctgcatagtgagctagagtccactcagggcagggcagctcactgagctgagaaggcagagatcagagttcaagacggctgaagcaactgcaatctgcagggcagggcaccagtgaggagacagctgatcaaaggtgcagctctcaaagtctatgtggggttccatgtgcatacttatcaaggagtggactctacctgcacaaggaaaagactaacagatttaacagaggggtggctgctatgaaattgagtttggaccagaggtacttgaggtggaggagggttggggaatgtatgatggagtttctgccatccatggtggga

SEQ ID NO: 425170 - DNA, 389 bp, Homo sapiens
aaacatattaagtccagggcataaaacctaaaccactgctcatatttattctttctaaatagagcaaagtgtaaaatcttctccataaaatgcacattgtgcttatgaaaaggccagtcttagtgagaatcattggtattccatagaagagtgaattaaacacagccaagggaagacccaagtctcatacttctcttgtatattccagagttccaggggaattccaggtgatagaggtgatctcccatactgttaaagcaaggttgcagacacttgggaattttggtcccagtactctaggaggtcacacctctgtcctggaaaatactacaggaatgtatactcttcctatgactcattctggtcattcttccagcatcacaaaaacc

SEQ ID NO: 425171 - DNA, 442 bp, Homo sapiens
ctaaagcggaggagaaactgttgagggaacctagaagtaaaggacatctggcttgctgggctccatttaaactttgagtatagcagagacacgagcccttcgggacacatgcctgtcgcagtgacactccaacttcggaagagtggaagccctgattccaaattcaagcatgctttgagtagaaattaagtttgcctctttttgcacaggaagatggccaatctttcctaagctgctcaccttacaagaaaacgaatcgtactgctaagaattcaaacttcagcagtcatgggtaagtaaggaagtcttataaatctattttagccacctaacaagaaactagaaatttagcaagttctttcacattcaggacagttgtgttgactagatcagaggcactgagacatgaagaacagacccctaaaaagggaaagtgttcctt

SEQ ID NO: 425172 - DNA, 896 bp, Homo sapiens
cgcccgccgcccccacaccatcggctagtcgagccccctgttattgggctgggtggcggttgagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggtcctgggggagtaggagccagtgcaaggagagaagtccattgagaaaggcaaatggatgacatcagacccaggggctgaggtccccaactgcagctgggtagcttctggagtggacaaggagcaacagggaagttcgtggcctggtgttctgggatccactgtctcatctcattcttgtgggcaccagaacgtatccaaagacaagactcagtgtctctggcaacagtgagccagagatagaatgtgtttcagaggaggaggaaggggttgttgtaccccatggaaacagtatattgttttacagtagcgtgtctttctctaataactacttagcgtgttcctgttaatggaaaatattggtggtgtaagtt

SEQ ID NO: 425173 - DNA, 1237 bp, Homo sapiens
cgcccgccgcccccacaccatcggctagtcgagccccctgttattgggctgggtggcggttgagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacagctcccatcaaggaagatccagagacattctcctcaccaaggcgttaagaaatgcacaggtgaggggaacagcggcatgcgtttaaaagtcctgtggcgcccatcctctgcaggctggaggtcatggcgggagctgctgcatggatttgccctccctgctgtcagtgagaacaacagggttctggaagagtagaggacaggccgtgggacttggccatctagagacaaggcgggagggatttccctgagaggcagggatatgtggtggttactaatcattcgaatcattgtgaggtgtctgggaatgtaatggatgggacatctactaagaaatcaacttacgttacacttagaaaagctctagttctgaggacagagacctgatggagtcaccatagtgggaatttatgacctggcatccagttcagatacctggagcttcttgactgaggggagattggatcccttgaggaagagtgaagccttcaatgctgccacaagtgtatgctgtaaatcttccttcaggccttccccagaaggccctgaagccatttatgtgggtgactgaagaaagggaaatactcagagcttctgtggcttgttggatgctggctctgaagaatgctaaactgagggccctgcggtggccatgaaaatgcactacttgcatctccagctgcaggaggcctaacgaatcagcagcctcagctgctac

SEQ ID NO: 425174 - DNA, 1107 bp, Homo sapiens
gtttaatcattctccaaagccagtcagcagtattcaatgcccgtacataattttactacagatataccatgccttttatcattttcctgctttatatgagaaatagtgtattggtcatcttgtttttataacttaaacatggaaaaatcaattatattagatctttatcttaattgtttttagtgatcagtttcataagatatacttttagttctcattgatttttataatattcctcaaaatagctatttgaattgaagaatgaaaaactttttctcacagaaagtgtatctgatttggctgactggtttgacagtgaagactggccctgccaatgaggttttatgacagatatttttcataaatgagctaaatctgcaactccaaattagtggcaatacatttaaaacaagaaataagatcaaagcattttatcaaaaagcattgttttggcaaacatgtaataaaactaaaaatttgtttgattttcctgccatttctggtgatacgggttttaaaaggtgggcctaagtacaagtgttacagcacaattaacaataatttgatgaatcttagtaaagctctcttggtatacttcccagaaattgagaaagtaaattattcaaattgctggagaacaaatctctttgctagtcaggtgcttcctagttcactgtttaaaagaaatgaagaaggactttatcaaattgtcatgtgcccgaagattaaaaatatttttgctaatagaccattacacaaatgttgacatataacatagaaggaattcaaagaactgaattacattgctataataaaacactctcaattccttcaacttacatctataaaaacaaaaaaaaaaaaatagaaatagaattgatactgaccccttatttcagcagtaagtaatgttcatttacagataaaggaactaactgaaaaaagtttatcatctcattaaaggatgcatttgcaatataattttactttttgtgtttaataatatgtttatgtttaatcagtagtgtattgataataattcaattgcataaatttttttaatgttcagagctttatggtaacaaaataaaagtaaaaaattgaaat

SEQ ID NO: 425175 - DNA, 666 bp, Homo sapiens
tgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425176 - DNA, 1027 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacaggga

SEQ ID NO: 425177 - DNA, 404 bp, Homo sapiens
  misc_feature (25)..(25): n is a, c, g, or t
ccatgcgtccgcccaacgtcgcccnagcgtccgctgctgctcctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425178 - DNA, 472 bp, Homo sapiens
gtgatctgggctcactgaaacctccgcctcctgggttcaagtgattctcttgcctcagcctcctgagtagctaggattacaggtgcccgccatcatgcccagctaatttttgtatttttagtagagacagggtttcaccatgttggccagcttggtctcgaactcctgacctcaggtgatcctgctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425179 - DNA, 1203 bp, Homo sapiens
tgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaaaaaaaaaaaaaacaaaaaaaaaaaaaaaaaaaaaaaaaaaaaaaaaaaaaaaggggggggggcgcgcgcgataagatatagattcctctctcagagaggggcgcacaccccctaaggcgcacgacaccgcccgctctcttctagtgcaaaagcaagtgggcctcctatagtgcagagcgaggctaatatatatatagccggccctagggccgcgcgggacgacgcttgtctatccccaacaccctctactgactgcaaggtgagcacgaaccacacacctcccgcctaccacgcgctaaacgagtgcataatttgccgatggagtggccaagcgcgcgccaccctccattcaatctcagtgggcggggcggcgtacccgccatactttgtgtccgaggccacaaaccactaccacctatgccaagacacgacatcatctattcgacaccagccgtctggctgggcgcggacacagctcacccaaccgacgaaacaccgtacatcgtcggcgtgataaccatataatcaagcgtcccc

SEQ ID NO: 425180 - DNA, 302 bp, Homo sapiens
aggatccataatgtgtgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggggcacacattatggagtgggcacacattatggagagtgggcacacattatggag

SEQ ID NO: 425181 - DNA, 2473 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425182 - DNA, 2329 bp, Homo sapiens
  misc_feature (12)..(12): n is a, c, g, or t
  misc_feature (43)..(43): n is a, c, g, or t
aagaaaaaaaanaaactatgctagggtacgagtgctgcgtgtnaatcggccgaggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425183 - DNA, 2185 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgt

SEQ ID NO: 425184 - DNA, 1316 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425185 - DNA, 2971 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425186 - DNA, 2288 bp, Homo sapiens
aattagcttaggtaggctgtgtgtgatcggcgaggcagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425187 - DNA, 2568 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaaggtgggcttgactggaggaaggagggtgtgaagccgaggggtggtggctataacgtacagcaaccctgtgtcggtgccccctgcccgcttctctagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425188 - DNA, 3066 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaaggtgggcttgactggaggaaggagggtgtgaagccgaggggtggtggctataacgtacagcaaccctgtgtcggtgccccctgcccgcttctctagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425189 - DNA, 2631 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaaaaaaaaaaaaaacaaaaaaaaaaaaaaaaaaaaaaaccccaattttttttttagggggcgcaggggggggagacgaggtttgcgacacaacgggggccccaggggcggcggggaaatggcaggggggggggggcccgggcccacaaatctgcccccca

SEQ ID NO: 425190 - DNA, 2497 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaatatgatttgtgttcatgtaaagcc

SEQ ID NO: 425191 - DNA, 2305 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctacccattcctgtccatcctgctctcgaatgatagatcaacttagggcgtgcaggatgaggtcatgtaagtaatcccgcaaatttggagatttaggtggaaggatcaattcagcatatgagttgttgtccatcctgggcagcatggtattattatgttacttaaataaaataaacttaaacc

SEQ ID NO: 425192 - DNA, 2138 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcataaccacgaaacgggggatgttgttagctagagtttc

SEQ ID NO: 425193 - DNA, 1474 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaaaaaaaaaaaaaacaaaaaaaaaaaaaaaaaaaaaaaccccaattttttttttagggggcgcaggggggggagacgaggtttgcgacacaacgggggccccaggggcggcggggaaatggcaggggggggggggcccgggcccacaaatctgcccccca

SEQ ID NO: 425194 - DNA, 2683 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgt

SEQ ID NO: 425195 - DNA, 2146 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcaggctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425196 - DNA, 2423 bp, Homo sapiens
  misc_feature (12)..(12): n is a, c, g, or t
  misc_feature (43)..(43): n is a, c, g, or t
aagaaaaaaaanaaactatgctagggtacgagtgctgcgtgtnaatcggccgaggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425197 - DNA, 1233 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagagccagcaggtttttacttgagtacaataaaaagtctgagtcaa

SEQ ID NO: 425198 - DNA, 1606 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtctatgttgcccgaagtcaacctcagggatcctctaga

SEQ ID NO: 425199 - DNA, 1823 bp, Homo sapiens
tgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425200 - DNA, 1343 bp, Homo sapiens
ccacacccatactcagcccctgcaggcaaggagagaacaggtcaggttcccgagagctcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425201 - DNA, 1696 bp, Homo sapiens
gtgatctgggctcactgaaacctccgcctcctgggttcaagtgattctcttgcctcagcctcctgagtagctaggattacaggtgcccgccatcatgcccagctaatttttgtatttttagtagagacagggtttcaccatgttggccagcttggtctcgaactcctgacctcaggtgatcctgctgcatcgacctcccaaagtactgggattacaggcgtgagccaccacgctcagcctctttcttgttctatatgtccatgctctgctccacttctggcccttcactctgccccacacatcactccagactggccttgtggtcagagcctggaatgcctgggctgctgggggcctgtggactgcactgggccagaacccctgccgccttcaagactggcctgtagccagcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425202 - DNA, 1273 bp, Homo sapiens
agaagactcagaattagaagaggaacatggagctgatccaggacacctcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425203 - DNA, 739 bp, Homo sapiens
ggatcccagaattacccatcttgggggttaaatatgctatgaatacatggacgacaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425204 - DNA, 1190 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggatgaaggagagagggaggaccggggagggagagtggtgaacacctgctgggaactcagcacatgctgggatgctggcactccctgctttctgtagttatttgaagactatagccgctcccgctgcacaggcgctgtgatgcctcaatgcattgacccatgtgagccccaggatgttcctggcggaggaaagatctgtgaaggcagcatttctccttgcgcctcatcctggccacggccccggggtgggggtgcagggggttattattctcctttaacgattgcgttttcccggccttcctaccaaacc

SEQ ID NO: 425205 - DNA, 419 bp, Homo sapiens
ccaggtagacctaacactcctctgccaggcagatcacatgggcccttagcaggcagccagggtgggggcaacacaagggcccctcttcatcctggatggtctgggcgcacagggagcagcaggcccctggatccccctggtctggctcaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425206 - DNA, 582 bp, Homo sapiens
  misc_feature (12)..(12): n is a, c, g, or t
  misc_feature (43)..(43): n is a, c, g, or t
aagaaaaaaaanaaactatgctagggtacgagtgctgcgtgtnaatcggccgaggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccacatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacaggga

SEQ ID NO: 425207 - DNA, 746 bp, Homo sapiens
tgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagagggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425208 - DNA, 268 bp, Homo sapiens
ggtgaactctagaggatctcaattctgcacccacagccctagagggcaatgccttctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425209 - DNA, 291 bp, Homo sapiens
  misc_feature (12)..(12): n is a, c, g, or t
  misc_feature (43)..(43): n is a, c, g, or t
aagaaaaaaaanaaactatgctagggtacgagtgctgcgtgtnaatcggccgaggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccagcacgtggaccttccggaaacacctgggctgaatggggtcccgtcggctagtcggg

SEQ ID NO: 425210 - DNA, 1208 bp, Homo sapiens
  misc_feature (1174)..(1174): n is a, c, g, or t
  misc_feature (1178)..(1178): n is a, c, g, or t
  misc_feature (1182)..(1182): n is a, c, g, or t
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggcctgggaagagtaaactcgantaanaggncccggagaccgttgaacctgacctcg

SEQ ID NO: 425211 - DNA, 1396 bp, Homo sapiens
tggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagagggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425212 - DNA, 1841 bp, Homo sapiens
gtctgcactatgccccaggccctgggattttgaacagctctgcaggtgactgaaaggtgcggccaggctggggaacgacctggtttcagccccagccccgccactgactgactttgtgagtgcgggcaagtcactcagcctccctaggcctcagtgacttccctgaaagcaaaaactctgcaaaggggcagctgggtgctggctcacacctgtaatcccagcactttgggaggctgaggtagacaaatcacttgaggccaggagttctagaccagcctggccaacatggtgaaaccccatctctactaaagaaaaaaaaaaattagctgagcatggttgtacatgcttgtaatcccagctacttgggatgccgaggcgggaggattgcttgaacccaagaggtggagtttgcagtgagctgagattgtgccacactgcactccagcttgggtgagagtgagactccatctcaaaaaaaaaaaaaaaaaagagagaatcccactttcttgctgttgtgatggtggtaagggaacgggcctggctctggcccctgatgcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425213 - DNA, 2241 bp, Homo sapiens
gtctgcactatgccccaggccctgggattttgaacagctctgcaggtgactgaaaggtgcggccaggctggggaacgacctggtttcagccccagccccgccactgactgactttgtgagtgcgggcaagtcactcagcctccctaggcctcagtgacttccctgaaagcaaaaactctgcaaaggggcagctgggtgctggctcacacctgtaatcccagcactttgggaggctgaggtagacaaatcacttgaggccaggagttctagaccagcctggccaacatggtgaaaccccatctctactaaagaaaaaaaaaaattagctgagcatggttgtacatgcttgtaatcccagctacttgggatgccgaggcgggaggattgcttgaacccaagaggtggagtttgcagtgagctgagattgtgccacactgcactccagcttgggtgagagtgagactccatctcaaaaaaaaaaaaaaaaaagagagaatcccactttcttgctgttgtgatggtggtaagggaacgggcctggctctggcccctgatgcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 425214 - DNA, 830 bp, Homo sapiens
  misc_feature (12)..(12): n is a, c, g, or t
  misc_feature (43)..(43): n is a, c, g, or t
aagaaaaaaaanaaactatgctagggtacgagtgctgcgtgtnaatcggccgaggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcgggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425215 - DNA, 413 bp, Homo sapiens
gcggccgctccaacatcagaatggtctggttgcacagggagcagcaggcccctggatccccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 425216 - DNA, 228 bp, Homo sapiens
atggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggtaagtgaggagggccacccaccctctcccaggcggcagtccccaccttggtcagcaaggtcgtgccctcagcctgctca

SEQ ID NO: 425217 - DNA, 553 bp, Homo sapiens
  misc_feature (537)..(537): n is a, c, g, or t
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaatagtcagcagcnggggatcccctagagg

SEQ ID NO: 425218 - DNA, 1368 bp, Homo sapiens
agctggggcacttccgggatctcgctatccggccgccacccgcagctgcagcacagtcatggcccaggcgtcggccgccccggcccgagagggtgctcggcgccagcagcccggaggcccggcccgcgcaggaggcgctcctccttcccaccggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425219 - DNA, 667 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacctgcccacacacacag

SEQ ID NO: 425220 - DNA, 685 bp, Homo sapiens
gcaggacttcttaattacttaattgaatgaactttgtctaatatttcttcaagtaagtaattaagaagtcctgcttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425221 - DNA, 530 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagcaactcgggagtgcacttttcgactgtgacgattgtctaggacgactagtccgttcgttattacactaacagcaatggagaagcaatggtcaggtcagttt

SEQ ID NO: 425222 - DNA, 593 bp, Homo sapiens
agctggggcacttccgggatctcgctatccggccgccacccgcagctgcagcacagtcatggcccaggcgtcggccgccccggcccgagagggtgctcggcgccagcagcccggaggcccggcccgcgcaggaggcgctcctccttcccaccggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataagtatttaataaaacatttttaaaaccacatttgggggattgggataaggaatggttggattaagacaaggagactt

SEQ ID NO: 425223 - DNA, 1273 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatactaaaaaaaaacaagaaaaaaaacaaactcgggactaaaaaacggagtgagaaaaaagggcaggaagacacaaattgacaacaacagtaacagagacacgaaacatcgacacaagagacaaaagcgggacccataaggaacggataaactagaaacaccgggtaacggtaagaacgacgacacaaacagaagaggaacacaccaaacaacgagagacaacaaacaaagacgaaaagaacgatacaaaacacaccaaaacccagagaggtcagcgaacatgaacacgaataaaagaagacaaaaacaacaaacaagaga

SEQ ID NO: 425224 - DNA, 1786 bp, Homo sapiens
ggtgggcacgcttcggtttacctcccccgcgggtgacagcccagtgcttccaccacaaccgatgtcaactctcctagcgcccctccgctcaccgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatactaaaaaaaaacaagaaaaaaaacaaactcgggactaaaaaacggagtgagaaaaaagggcaggaagacacaaattgacaacaacagtaacagagacacgaaacatcgacacaagagacaaaagcgggacccataaggaacggataaactagaaacaccgggtaacggtaagaacgacgacacaaacagaagaggaacacaccaaacaacgagagacaacaaacaaagacgaaaagaacgatacaaaacacaccaaaacccagagaggtcagcgaacatgaacacgaataaaagaagacaaaaacaacaaacaagaga

SEQ ID NO: 425225 - DNA, 1246 bp, Homo sapiens
agctggggcacttccgggatctcgctatccggccgccacccgcagctgcagcacagtcatggcccaggcgtcggccgccccggcccgagagggtgctcggcgccagcagcccggaggcccggcccgcgcaggaggcgctcctccttcccaccgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425226 - DNA, 1501 bp, Homo sapiens
ggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctcacgttcacggaggacgtgactggaacccgtctccccttctccagtcgttccagtcctccccggccctctacttgagtggggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaagctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425227 - DNA, 1801 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacaggtttgcgctaagtgttgtctgtaacaaatatggcctacaatacttataaaaatgtcaacccacctgtttcaaacttggtatcccgcctaaatctttattcttctaggcttgtggtaattaatgagtataaatctttatcgcaactgtccactctattgtaatcccagcatatcaagataacttaggttggaatggtccattgcattcagtattaagaaaagatagacttctattaataaagacacagacaggcttgcctgagctcagaatccagcaatgtgtcacccctcacactgtgacccctgtaactgtagttctctgttctttaaagaaatagacattccactaacaacacatacaaactgtgacaagaagtgacaggggctgttatgtcaaagacttaagggtaatttttaaaaatcctcttaattcaactacatatcgggtacagtgtacactgctcaggtgacaggtgcaccaacatctcagaaatcaccactgaagaacttatccatgtaacctgaaaccacctgttccccaaaaggtattgaaatttaaaaagttacagttttatatgtttaaaaaagcctcttaattcatatagttattgtaagcagagaaattttcatttttactttttgtaacattttattcattgtttcagctggccaaaaaaaatgaggtatgatgaaattataattaataaaaagggtgaaggtgctgtattattttactaagtatgtgcatccaccactaggcaaggtctgaagaaataagcataaagtaatttatgattagctgccctaagactatttccttctcaaatgtttgtcttattcttagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425228 - DNA, 1123 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagaccaagcacttcccaaacagtgtgcctgagaaccacctgtagggctggtgaggacacagatagctgggcctatcccacagagattctgattcagtacaaataccaagaattgggggccaggcgcggtggctcacgcctgtaatcccagcactttgggagcccgagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425229 - DNA, 2855 bp, Homo sapiens
cgcctcggcctcccaaaatgctgggattacaggcatgagccaccgtgcccggcctcacttcatttcttcatcatagcctgctatgctgctgctttctcttggaagatactaatcagttctaggccctttgtaggtcaaatctaagatctggggcaaatacctgttttcatcgaaaatgactttttccttaaattaatgcttgcaattttgtgctatttattgttgaaaaccagcagaatcttgtacagtcagatggaaatctgcatgtcttagattgtggatctttaggtatctttatacagtaaaatctcactgaccactgtatatgaactagtattgttcataatacttcatcagtactcattccttgaaagaacataatcatcttcctaagtccctgagggcataaaagacatctaactgagtctccatctgcactcagtgtgggtcactaattttacacagggcttcaaaaaaaaaaactttagtgtgacgccgtcatgaaaagtaggttggtacgtttttaatcacaaaaatagacataatatttgaaacctgtaaataaaaatattttacaattctttgaaattaaatatttcagactgctttgccagcaacatgctcaattcccgatcatcgctcaaagtggtaagtttctaaaatttagcactgtgggttttaaagaaaggtaaacatttgtgtaacataaggaatagtctaattttctagcctcgttgaattaaaatacaaatgtttgagttaaaattttacacatctagaaaattgacaacttctttgtgtactatgtgatatgactgactaattttttcttctttatgaacaagacctattctctttgaaccattccctggtatctttcattctccctacgctcacagaaccaaactaagacatgggaaaaagccttgacttttgggactgcttctcttccataagaattttcagtagataaaattttaaaagtgctgcaccttccctgagtgaaaattccctaaggatgcatggttagcatttcagttctaattaaggcagactggatcctggctaactggagtcatggggtatactttcattcatgagtggaacagcagtgtcttagcagcactacatctgcaatgttcattgtgaagtggagtcaggacctcgttggaagacttcgttctgcgtcatgccaactgcattttatgagctaaattttcaggagtgaaaagaaaaagaggaaggaagaaacccctctcaggcaatcatgtacagccacccgaaacaatgaaatgtaatacattcataagacaagtgaaagaagagcatggcagacacacaggtttgcgctaagtgttgtctgtaacaaatatggcctacaatacttataaaaatgtcaacccacctgtttcaaacttggtatcccgcctaaatctttattcttctaggcttgtggtaattaatgagtataaatctttatcgcaactgtccactctattgtaatcccagcatatcaagataacttaggttggaatggtccattgcattcagtattaagaaaagatagacttctattaataaagacacagacaggcttgcctgagctcagaatccagcaatgtgtcacccctcacactgtgacccctgtaactgtagttctctgttctttaaagaaatagacattccactaacaacacatacaaactgtgacaagaagtgacaggggctgttatgtcaaagacttaagggtaatttttaaaaatcctcttaattcaactacatatcgggtacagtgtacactgctcaggtgacaggtgcaccaacatctcagaaatcaccactgaagaacttatccatgtaacctgaaaccacctgttccccaaaaggtattgaaatttaaaaagttacagttttatatgtttaaaaaagcctcttaattcatatagttattgtaagcagagaaattttcatttttactttttgtaacattttattcattgtttcagctggccaaaaaaaatgaggtatgatgaaattataattaataaaaagggtgaaggtgctgtattattttactaagtatgtgcatccaccactaggcaaggtctgaagaaataagcataaagtaatttatgattagctgccctaagactatttccttctcaaatgtttgtcttattcttagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425230 - DNA, 2452 bp, Homo sapiens
agctggggcacttccgggatctcgctatccggccgccacccgcagctgcagcacagtcatggcccaggcgtcggccgccccggcccgagagggtgctcggcgccagcagcccggaggcccggcccgcgcaggaggcgctcctccttcccaccgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgacctattctctttgaaccattccctggtatctttcattctccctacgctcacagaaccaaactaagacatgggaaaaagccttgacttttgggactgcttctcttccataagaattttcagtagataaaattttaaaagtgctgcaccttccctgagtgaaaattccctaaggatgcatggttagcatttcagttctaattaaggcagactggatcctggctaactggagtcatggggtatactttcattcatgagtggaacagcagtgtcttagcagcactacatctgcaatgttcattgtgaagtggagtcaggacctcgttggaagacttcgttctgcgtcatgccaactgcattttatgagctaaattttcaggagtgaaaagaaaaagaggaaggaagaaacccctctcaggcaatcatgtacagccacccgaaacaatgaaatgtaatacattcataagacaagtgaaagaagagcatggcagacacacaggtttgcgctaagtgttgtctgtaacaaatatggcctacaatacttataaaaatgtcaacccacctgtttcaaacttggtatcccgcctaaatctttattcttctaggcttgtggtaattaatgagtataaatctttatcgcaactgtccactctattgtaatcccagcatatcaagataacttaggttggaatggtccattgcattcagtattaagaaaagatagacttctattaataaagacacagacaggcttgcctgagctcagaatccagcaatgtgtcacccctcacactgtgacccctgtaactgtagttctctgttctttaaagaaatagacattccactaacaacacatacaaactgtgacaagaagtgacaggggctgttatgtcaaagacttaagggtaatttttaaaaatcctcttaattcaactacatatcgggtacagtgtacactgctcaggtgacaggtgcaccaacatctcagaaatcaccactgaagaacttatccatgtaacctgaaaccacctgttccccaaaaggtattgaaatttaaaaagttacagttttatatgtttaaaaaagcctcttaattcatatagttattgtaagcagagaaattttcatttttactttttgtaacattttattcattgtttcagctggccaaaaaaaatgaggtatgatgaaattataattaataaaaagggtgaaggtgctgtattattttactaagtatgtgcatccaccactaggcaaggtctgaagaaataagcataaagtaatttatgattagctgccctaagactatttccttctcaaatgtttgtcttattcttagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425231 - DNA, 936 bp, Homo sapiens
ctatttgttgatttttcatcatatgattttttagtgtctctttttctctccctattgtaacagctaatagagaagccaatgtactatttgaagtattatttgatgaagaatttcctggagggttaacaataaagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425232 - DNA, 1682 bp, Homo sapiens
ttttactgtaggcatatcatttagttatgcacagcaaaagactggttttcattttatgcaatattaaaatcaatgtaatgcaatcttgattttctctcctagccacccgaaacaatgaaatgtaatacattcataagacaagtgaaagaagagcatggcagacacacaggtttgcgctaagtgttgtctgtaacaaatatggcctacaatacttataaaaatgtcaacccacctgtttcaaacttggtatcccgcctaaatctttattcttctaggcttgtggtaattaatgagtataaatctttatcgcaactgtccactctattgtaatcccagcatatcaagataacttaggttggaatggtccattgcattcagtattaagaaaagatagacttctattaataaagacacagacaggcttgcctgagctcagaatccagcaatgtgtcacccctcacactgtgacccctgtaactgtagttctctgttctttaaagaaatagacattccactaacaacacatacaaactgtgacaagaagtgacaggggctgttatgtcaaagacttaagggtaatttttaaaaatcctcttaattcaactacatatcgggtacagtgtacactgctcaggtgacaggtgcaccaacatctcagaaatcaccactgaagaacttatccatgtaacctgaaaccacctgttccccaaaaggtattgaaatttaaaaagttacagttttatatgtttaaaaaagcctcttaattcatatagttattgtaagcagagaaattttcatttttactttttgtaacattttattcattgtttcagctggccaaaaaaaatgaggtatgatgaaattataattaataaaaagggtgaaggtgctgtattattttactaagtatgtgcatccaccactaggcaaggtctgaagaaataagcataaagtaatttatgattagctgccctaagactatttccttctcaaatgtttgtcttattcttagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425233 - DNA, 839 bp, Homo sapiens
ttttactgtaggcatatcatttagttatgcacagcaaaagactggttttcattttatgcaatattaaaatcaatgtaatgcaatcttgattttctctcctagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425234 - DNA, 891 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425235 - DNA, 718 bp, Homo sapiens
  misc_feature (702)..(702): n is a, c, g, or t
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagaccaagcacttcccaaacagtgtgcctgagaaccacctgtagggctggtgaggacacagatagctgggcctatcccacagagattctgattcagtacaaataccaagaattgggggccaggcgcggtggctcacgcctgtaatcccagcactttgggagcccgagactatgaagaaatcgggagtgcactttttgactgtagattgttcgaagacacatttgtaaattttcaagcagcaatagagaaaaaaattcatgcatctcaacaaatagtcagcagcnggggatcccctagagg

SEQ ID NO: 425236 - DNA, 1580 bp, Homo sapiens
cgcctcggcctcccaaaatgctgggattacaggcatgagccaccgtgcccggcctcacttcatttcttcatcatagcctgctatgctgctgctttctcttggaagatactaatcagttctaggccctttgtaggtcaaatctaagatctggggcaaatacctgttttcatcgaaaatgactttttccttaaattaatgcttgcaattttgtgctatttattgttgaaaaccagcagaatcttgtacagtcagatggaaatctgcatgtcttagattgtggatctttaggtatctttatacagtaaaatctcactgaccactgtatatgaactagtattgttcataatacttcatcagtactcattccttgaaagaacataatcatcttcctaagtccctgagggcataaaagacatctaactgagtctccatctgcactcagtgtgggtcactaattttacacagggcttcaaaaaaaaaaactttagtgtgacgccgtcatgaaaagtaggttggtacgtttttaatcacaaaaatagacataatatttgaaacctgtaaataaaaatattttacaattctttgaaattaaatatttcagactgctttgccagcaacatgctcaattcccgatcatcgctcaaagtggtaagtttctaaaatttagcactgtgggttttaaagaaaggtaaacatttgtgtaacataaggaatagtctaattttctagcctcgttgaattaaaatacaaatgtttgagttaaaattttacacatctagaaaattgacaacttctttgtgtactatgtgatatgactgactaattttttcttctttatgaacaagacctattctctttgaaccattccctggtatctttcattctccctacgctcacagaaccaaactaagacatgggaaaaagccttgacttttgggactgcttctcttccataagaattttcagtagataaaattttaaaagtgctgcaccttccctgagtgaaaattccctaaggatgcatggttagcatttcagttctaattaaggcagactggatcctggctaactggagtcatggggtatactttcattcatgagtggaacagcagtgtcttagcagcactacatctgcaatgttcattgtgaagtggagtcaggacctcgttggaagacttcgttctgcgtcatgccaactgcattttatggtgataacattctccaaatagcacctctacaatcatttttcagtcgttacccttttaactcagcaggaaaggctattacagatacttctttaaatcagtgtttattgacagggaaaagcaccagcaatacacacttaaccaaatccttgcaaatgtcatctattaaatatcttcatccttattagtctgttttactttgaatatcttctgagtgaaattgagtgcattcccatatcttttcaccaattatatttgttttcctatgacccaatttgttcatttttctattcaatgaaccctctccccagagagttccccatgtgccaatttttctactcaattatttacctgttttgcattaaacttataata

SEQ ID NO: 425237 - DNA, 1160 bp, Homo sapiens
ttttactgtaggcatatcatttagttatgcacagcaaaagactggttttcattttatgcaatattaaaatcaatgtaatgcaatcttgattttctctcctagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcattaagatgccctcaagacaggctacacctccacttgtttatgagtctggtctgacttctctatcaaggctgccacacacagctgggcaggccgggcacagagtcaaacagcattggtggatggctccccctgaagttgcacaacagagtgagtgccctccacactctgcatttccacagatgcatctgtctctccagcatatggtaggaagacaataagatttccctgtgaagaaatcattagttcatatccctgtctcaacatacacaacctttctcattttggcttctatattatacatttctatttgaattttttactacatttataaccagcaggaaaaatactttgaaaaatctaccaaaaagagtgtctgtcttaatagtcttttgaggatgtctgctaatatatagcagtatccatatttttttaaagcagccttaaaaatttttttctaaaaagagttattttgtaggggacttccatgtgtgtttttctttcatgtaagggaacatgtcacacatcactacttggatggattaggtgggagtacatatattatagtgtagtatggcgggggtgccactacttagaactgcatgagattcaacttaaaaggcttaagttgggtttcactaccctggttgataaaaacttgcttaatttagccttactcatattttaagttaactatacgtatgcagttattctgaataaagtttgtatatgtgtgtaactgttcgattttgaggcttttaaaaattacattgccattgactactatt

SEQ ID NO: 425238 - DNA, 958 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425239 - DNA, 1845 bp, Homo sapiens
agctggggcacttccgggatctcgctatccggccgccacccgcagctgcagcacagtcatggcccaggcgtcggccgccccggcccgagagggtgctcggcgccagcagcccggaggcccggcccgcgcaggaggcgctcctccttcccaccgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatactaaaaaaaaacaagaaaaaaaacaaactcgggactaaaaaacggagtgagaaaaaagggcaggaagacacaaattgacaacaacagtaacagagacacgaaacatcgacacaagagacaaaagcgggacccataaggaacggataaactagaaacaccgggtaacggtaagaacgacgacacaaacagaagaggaacacaccaaacaacgagagacaacaaacaaagacgaaaagaacgatacaaaacacaccaaaacccagagaggtcagcgaacatgaacacgaataaaagaagacaaaaacaacaaacaagaga

SEQ ID NO: 425240 - DNA, 1084 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatactaaaaaaaaacaatcggaacacaagtcagtaattagtagacacagcagatcgtaccaacggccggctaaagggcccgacactaaaataccatcgaccacaccacgagccaaacacacacaacgggcag

SEQ ID NO: 425241 - DNA, 1343 bp, Homo sapiens
ggtgggcacgcttcggtttacctcccccgcgggtgacagcccagtgcttccaccacaaccgatgtcaactctcctagcgcccctccgctcaccggtaaaccaggacagtggaggggcgccctgatgcggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatacta

SEQ ID NO: 425242 - DNA, 1279 bp, Homo sapiens
aaccctttatcaggacctgctgctgactatttgttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcattaagatgccctcaagacaggctacacctccacttgtttatgagtctggtctgacttctctatcaaggctgccacacacagctgggcaggccgggcacagagtcaaacagcattggtggatggctccccctgaagttgcacaacagagtgagtgccctccacactctgcatttccacagatgcatctgtctctccagcatatggtaggaagacaataagatttccctgtgaagaaatcattagttcatatccctgtctcaacatacacaacctttctcattttggcttctatattatacatttctatttgaattttttactacatttataaccagcaggaaaaatactttgaaaaatctaccaaaaagagtgtctgtcttaatagtcttttgaggatgtctgctaatatatagcagtatccatatttttttaaagcagccttaaaaatttttttctaaaaagagttattttgtaggggacttccatgtgtgtttttctttcatgtaagggaacatgtcacacatcactacttggatggattaggtgggagtacatatattatagtgtagtatggcgggggtgccactacttagaactgcatgagattcaacttaaaaggcttaagttgggtttcactaccctggttgataaaaacttgcttaatttagccttactcatattttaagttaactatacgtatgcagttattctgaataaagtttgtatatgtgtgtaactgttcgattttgaggcttttaaaaattacattgccattgactactatt

SEQ ID NO: 425243 - DNA, 3081 bp, Homo sapiens
ttctaaattgttggcatgtctttttctcaggctatcagaagtaacaacatttttcatttcagacatgcaatcacctattaatgatgaaatattttaccactttgggaatatttaattagtttagtcatggagaatacttcccacattttaagatttttcaaatatcactgtcatttctattttagcattttatcaaattattgcttttttattttataataaggcttaagacagattatagacctccttaagagatgagtttcttcttctaaaaatgcatgttgatagaggactatttaggctaatcggaggaatcattaagaaagaaagttttaacactgtttatccctatctgctttccttgcactttttctgtgaaaaatattttctgtttgcaaaatcttccctgagttctgaacccagcaccatcagtaccaaagtcttatgcaatatgtatttattatgctcctgaaataggcctcttcttgatgagacccaaactattacaaaaatatcagtattcatattttactcacaattcatacccgtgcttacttagttggcattttagtgctttgaatttctatcttaaagcacagaaaaaaaaaggtaatttaatccaagtattctatcatcaaaattattgtctgattatatgaagataaatgactggcgactctggttgtgtgtgtatgtgttttgcttttactttaattcttgcaatccaaatatagaattatatatttatctattattgcctttattctttaagcacttgagtttaatgattattcttacctgagaaaggaagaaatttaattctaccagtgatgaatacttgaaattaattgaactcataccaaaagatgtaatccagtttctcagtttgaaggagaacgtttgactcactttcattgttcatgctagctgaatataatcaagacttttgatttgatttgcttttattattcaatgcagatagagcctgataagttttagaacatttaaagaagattgaaatctcagtcagtaactaaatgataaaatgagattgattggcttatactaggtacatttatttttgaaagaattaatgtaaaataatagttatttttaaagcagctaatattacactgataatttgttgctaaatttagtgctgtccacatcataggtgcttaaatatgtactggttaactagaggggggtaggaaagcaagcggttttatcttgttcttacctttttgcaggaaaagtggctttaaaaaaatttatataataaaactattttggaaattcattcttttagaaagagaccttgagataaatattttttgactctggatatttctatagttctgaacacagattttaaacccactatcaaaatgaaaacaatataaagctatattagtgagtctccatgtagcagtttgtttttatagttactgtttcatgcttaaaacttcattcttactttcattaatgttacccttcactggtatagccactcactaaataagtatatttaaaacatcaaaattttgaactaaagtttgtgattctcttattcagcaatccttatcttatgctggctgcatgagttaattcaacatccagattaaatatcctgaagtaggttctatatatttcctcatacaacagacatggaatggaaatgccactagaaactgccctgctacttttaagtctgacctttgcaggaggtacactttgctgttctatgattgtattcacctacctaaaatacaaatgaagacagaacatatcatttactgcacgatgaatttttcatttattaaatgaaaaacgtttgctagacattttaaatattaagtattttgactacacggattaatttaaatgattctatcaggcattctgatatttaacaactctattaaaatatttatagaaaaataaaagcaaattgatataaatttttgagcaattctatttttgtagaaaaaagataacctgtaattataaagatgttttttgaatgtgtagtatcctagaaaataaaagttcttgtgaaacttaaaaaatgaatgaaaaccaactaatagcatgcaagatcatagatcctgcattaaatttttatttgtgaaaatttgaaaattatgagctataacttataaagtttgccttcttatgtctaaaatcttttaaaggattatttgcatttatgtaaaactggaaatgaagttatatatgagtgcaaagaaattgacttctgctcaaatatgtgttgataccctacagtaaattgaattaaatttttatcccaactgtttgattttattatttcatggactagccttacgttaagtgaaatactatttatgttgttaccacccctaagagtgactctgatatattatggatgacccaggacggtcttaaaggtctagttttaaaaactgcctagtttgtaagtatttgaatccagttcttttctaaattttaataatttgactcaaaatttttgctacagggtcaacttttaaattgtatatttcctctgaggcacactgggcatttggagaatggttcttcactggtgtagagagccaggtttactgttggttgcaccatctgttatcaggcatgcagaaacatttttcttctggagaaacagaggggaaggtgttgttacagtgtacatgtttcctctgtgtcgtttttaagggaaataaacatgttccaaaagatgctgttaaaataaatatttgaacacgttttctgtttctaggttgctcttaattccaaacatttaaataaatgtgcatttgaatagctttaggtggtttagtctattagctgaaatggaaaagttcatgtattgacatcatcaataatacttcataaaggtttatgtatttttatgtgtttggattccataagaagttgaacttagataattttatcaagagtagcacagtgtttctcaggtgcgagccagcatacagcgagacccttcatgtgtctctggatgcacatatatcttcccaaccttaaacacagctcattgaaatacattaaagctactgaaagtga

SEQ ID NO: 425244 - DNA, 3027 bp, Homo sapiens
ttctaaattgttggcatgtctttttctcaggctatcagaagtaacaacatttttcatttcagacatgcaatcacctattaatgatgaaatattttaccactttgggaatatttaattagtttagtcatggagaatacttcccacattttaagatttttcaaatatcactgtcatttctattttagcattttatcaaattattgcttttttattttataataaggcttaagacagattatagacctccttaagagatgagtttcttcttctaaaaatgcatgttgatagaggactatttaggctaatcggaggaatcattaagaaagaaagttttaacactgtttatccctatctgctttccttgcactttttctgtgaaaaatattttctgtttgcaaaatcttccctgagttctgaacccagcaccatcagtaccaaagtcttatgcaatatgtatttattatgctcctgaaataggcctcttcttgatgagacccaaactattacaaaaatatcagtattcatattttactcacaattcatacccgtgcttacttagttggcattttagtgctttgaatttctatcttaaagcacagaaaaaaaaaggtaatttaatccaagtattctatcatcaaaattattgtctgattatatgaagataaatgactggcgactctggttgtgtgtgtatgtgttttgcttttactttaattcttgcaatccaaatatagaattatatatttatctattattgcctttattctttaagcacttgagtttaatgattattcttacctgagaaaggaagaaatttaattctaccagtgatgaatacttgaaattaattgaactcataccaaaagatgtaatccagtttctcagtttgaaggagaacgtttgactcactttcattgttcatgctagctgaatataatcaagacttttgatttgatttgcttttattattcaatgcagatagagcctgataagttttagaacatttaaagaagattgaaatctcagtcagtaactaaatgataaaatgagattgattggcttatactaggtacatttatttttgaaagaattaatgtaaaataatagttatttttaaagcagctaatattacactgataatttgttgctaaatttagtgctgtccacatcataggtgcttaaatatgtactggttaactagaggggggtaggaaagcaagcggttttatcttgttcttacctttttgcaggaaaagtggctttaaaaaaatttatataataaaactattttggaaattcattcttttagaaagagaccttgagataaatattttttgactctggatatttctatagttctgaacacagattttaaacccactatcaaaatgaaaacaatataaagctatattagtgagtctccatgtagcagtttgtttttatagttactgtttcatgcttaaaacttcattcttactttcattaatgttacccttcactggtatagccactcactaaataagtatatttaaaacatcaaaattttgaactaaagtttgtgattctcttattcagcaatccttatcttatgctggctgcatgagttaattcaacatccagattaaatatcctgaagtaggttctatatatttcctcatacaacagacatggaatggaaatgccactagaaactgccctgctacttttaagtctgacctttgcaggaggtacactttgctgttctatgattgtattcacctacctaaaatacaaatgaagacagaacatatcatttactgcacgatgaatttttcatttattaaatgaaaaacgtttgctagacattttaaatattaagtattttgactacacggattaatttaaatgattctatcaggcattctgatatttaacaactctattaaaatatttatagaaaaataaaagcaaattgatataaatttttgagcaattctatttttgtagaaaaaagataacctgtaattataaagatgttttttgaatgtgtagtatcctagaaaataaaagttcttgtgaaacttaaaaaatgaatgaaaaccaactaatagcatgcaagatcatagatcctgcattaaatttttatttgtgaaaatttgaaaattatgagctataacttataaagtttgccttcttatgtctaaaatcttttaaaggattatttgcatttatgtaaaactggaaatgaagttatatatgagtgcaaagaaattgacttctgctcaaatatgtgttgataccctacagtaaattgaattaaatttttatcccaactgtttgattttattatttcatggactagccttacgttaagtgaaatactatttatgttgttaccacccctaagagtgactctgatatattatggatgacccaggacggtcttaaaggtctagttttaaaaactgcctagtttgtaagtatttgaatccagttcttttctaaattttaataatttgactctgggcatttggagaatggttcttcactggtgtagagagccaggtttactgttggttgcaccatctgttatcaggcatgcagaaacatttttcttctggagaaacagaggggaaggtgttgttacagtgtacatgtttcctctgtgtcgtttttaagggaaataaacatgttccaaaagatgctgttaaaataaatatttgaacacgttttctgtttctaggttgctcttaattccaaacatttaaataaatgtgcatttgaatagctttaggtggtttagtctattagctgaaatggaaaagttcatgtattgacatcatcaataatacttcataaaggtttatgtatttttatgtgtttggattccataagaagttgaacttagataattttatcaagagtagcacagtgtttctcaggtgcgagccagcatacagcgagacccttcatgtgtctctggatgcacatatatcttcccaaccttaaacacagctcattgaaatacattaaagctactgaaagtga

SEQ ID NO: 425245 - DNA, 3027 bp, Homo sapiens
ttctaaattgttggcatgtctttttctcaggctatcagaagtaacaacatttttcatttcagacatgcaatcacctattaatgatgaaatattttaccactttgggaatatttaattagtttagtcatggagaatacttcccacattttaagatttttcaaatatcactgtcatttctattttagcattttatcaaattattgcttttttattttataataaggcttaagacagattatagacctccttaagagatgagtttcttcttctaaaaatgcatgttgatagaggactatttaggctaatcggaggaatcattaagaaagaaagttttaacactgtttatccctatctgctttccttgcactttttctgtgaaaaatattttctgtttgcaaaatcttccctgagttctgaacccagcaccatcagtaccaaagtcttatgcaatatgtatttattatgctcctgaaataggcctcttcttgatgagacccaaactattacaaaaatatcagtattcatattttactcacaattcatacccgtgcttacttagttggcattttagtgctttgaatttctatcttaaagcacagaaaaaaaaaggtaatttaatccaagtattctatcatcaaaattattgtctgattatatgaagataaatgactggcgactctggttgtgtgtgtatgtgttttgcttttactttaattcttgcaatccaaatatagaattatatatttatctattattgcctttattctttaagcacttgagtttaatgattattcttacctgagaaaggaagaaatttaattctaccagtgatgaatacttgaaattaattgaactcataccaaaagatgtaatccagtttctcagtttgaaggagaacgtttgactcactttcattgttcatgctagctgaatataatcaagacttttgatttgatttgcttttattattcaatgcagatagagcctgataagttttagaacatttaaagaagattgaaatctcagtcagtaactaaatgataaaatgagattgattggcttatactaggtacatttatttttgaaagaattaatgtaaaataatagttatttttaaagcagctaatattacactgataatttgttgctaaatttagtgctgtccacatcataggtgcttaaatatgtactggttaactagaggggggtaggaaagcaagcggttttatcttgttcttacctttttgcaggaaaagtggctttaaaaaaatttatataataaaactattttggaaattcattcttttagaaagagaccttgagataaatattttttgactctggatatttctatagttctgaacacagattttaaacccactatcaaaatgaaaacaatataaagctatattagtgagtctccatgtagcagtttgtttttatagttactgtttcatgcttaaaacttcattcttactttcattaatgttacccttcactggtatagccactcactaaataagtatatttaaaacatctggctgcatgagttaattcaacatccagattaaatatcctgaagtaggttctatatatttcctcatacaacagacatggaatggaaatgccactagaaactgccctgctacttttaagtctgacctttgcaggaggtacactttgctgttctatgattgtattcacctacctaaaatacaaatgaagacagaacatatcatttactgcacgatgaatttttcatttattaaatgaaaaacgtttgctagacattttaaatattaagtattttgactacacggattaatttaaatgattctatcaggcattctgatatttaacaactctattaaaatatttatagaaaaataaaagcaaattgatataaatttttgagcaattctatttttgtagaaaaaagataacctgtaattataaagatgttttttgaatgtgtagtatcctagaaaataaaagttcttgtgaaacttaaaaaatgaatgaaaaccaactaatagcatgcaagatcatagatcctgcattaaatttttatttgtgaaaatttgaaaattatgagctataacttataaagtttgccttcttatgtctaaaatcttttaaaggattatttgcatttatgtaaaactggaaatgaagttatatatgagtgcaaagaaattgacttctgctcaaatatgtgttgataccctacagtaaattgaattaaatttttatcccaactgtttgattttattatttcatggactagccttacgttaagtgaaatactatttatgttgttaccacccctaagagtgactctgatatattatggatgacccaggacggtcttaaaggtctagttttaaaaactgcctagtttgtaagtatttgaatccagttcttttctaaattttaataatttgactcaaaatttttgctacagggtcaacttttaaattgtatatttcctctgaggcacactgggcatttggagaatggttcttcactggtgtagagagccaggtttactgttggttgcaccatctgttatcaggcatgcagaaacatttttcttctggagaaacagaggggaaggtgttgttacagtgtacatgtttcctctgtgtcgtttttaagggaaataaacatgttccaaaagatgctgttaaaataaatatttgaacacgttttctgtttctaggttgctcttaattccaaacatttaaataaatgtgcatttgaatagctttaggtggtttagtctattagctgaaatggaaaagttcatgtattgacatcatcaataatacttcataaaggtttatgtatttttatgtgtttggattccataagaagttgaacttagataattttatcaagagtagcacagtgtttctcaggtgcgagccagcatacagcgagacccttcatgtgtctctggatgcacatatatcttcccaaccttaaacacagctcattgaaatacattaaagctactgaaagtga

SEQ ID NO: 425246 - DNA, 3363 bp, Homo sapiens
  misc_feature (13)..(14): n is a, c, g, or t
cgagcggccggcnncctcccttccccgcctccgccggcgctgcctcctccctccgcccagctcggcctcccttgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatga

SEQ ID NO: 425247 - DNA, 3414 bp, Homo sapiens
  misc_feature (13)..(14): n is a, c, g, or t
cgagcggccggcnncctcccttccccgcctccgccggcgctgcctcctccctccgcccagctcggcctcccttgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgaaaaaaaaaccacaccacactatgtaatataattcggggagtgggggaaata

SEQ ID NO: 425248 - DNA, 3300 bp, Homo sapiens
  misc_feature (13)..(14): n is a, c, g, or t
cgagcggccggcnncctcccttccccgcctccgccggcgctgcctcctccctccgcccagctcggcctcccttgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatga

SEQ ID NO: 425249 - DNA, 2022 bp, Homo sapiens
ttttttttttctccccactacctctcctctttgttttgtactgccctctcctggctaataaatttcttagtaatgaatatttagagaagccaagtggcggaaacactgggggctgctatcatttctactttccgttagaaatttcagattttattatatgaaatgcagagttgacatacagtgattaattcagatgtgcatagatacaagattgctgaaatgatatcaattgttgtagaaatatctgtatgagagtaatttggtcatttatatggactttgcaatgtttatgaaaaatgattttgcagtttattgcatcattagtcaaattttctgagtcattgatgtgaaaatccactgttattggaaataatctggaaactttctctctacgtttatattttacagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatga

SEQ ID NO: 425250 - DNA, 2052 bp, Homo sapiens
  misc_feature (13)..(14): n is a, c, g, or t
cgagcggccggcnncctcccttccccgcctccgccggcgctgcctcctccctccgcccagctcggcctcccttgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttgaatcaatttttgcatttggaagcatttgactctgcagcgttagggaacgttttctgattgtgactggaagtgtcctcttctatgagcatagctttttcttatcgtcacacctttgactaagagcggccatataagaatcttgaagcctagatcattttgcttgcagtttgtattgcaacttgaccataaagacaaaattacactgaattcaaagcaacactcttaataaagctttcct

SEQ ID NO: 425251 - DNA, 3527 bp, Homo sapiens
  misc_feature (13)..(14): n is a, c, g, or t
cgagcggccggcnncctcccttccccgcctccgccggcgctgcctcctccctccgcccagctcggcctcccttgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgaaaaaaagacaagaaacgccaagctcttttatatttaattttctaataaaaacctggggggggggcccggttcccatttcgccttatgagaagtggataacccgcgctaactgtccgggtgtttaaaaccgccgggactggaaaaacccctgccgttacccaact

SEQ ID NO: 425252 - DNA, 2070 bp, Homo sapiens
  misc_feature (13)..(14): n is a, c, g, or t
cgagcggccggcnncctcccttccccgcctccgccggcgctgcctcctccctccgcccagctcggcctcccttgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaactta

SEQ ID NO: 425253 - DNA, 1656 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagc

SEQ ID NO: 425254 - DNA, 2460 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaagtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttaaaaaaagaca

SEQ ID NO: 425255 - DNA, 1687 bp, Homo sapiens
agcttctgctgggacagcgacacaggcaactttttccgaagctccttccgtaggatcccgtcattgagcagcacaggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttaaaaaaagaca

SEQ ID NO: 425256 - DNA, 1754 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcactgtatccttagcgcggggcaggatagggctggcactgtgggctggggattgagtggggagtgtgctgagca

SEQ ID NO: 425257 - DNA, 2174 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttaaaaaaagaca

SEQ ID NO: 425258 - DNA, 1868 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcagctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttaaaaaaagaca

SEQ ID NO: 425259 - DNA, 2078 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagc

SEQ ID NO: 425260 - DNA, 2596 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttaaaaaaagaca

SEQ ID NO: 425261 - DNA, 2522 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttaaaaaaagaca

SEQ ID NO: 425262 - DNA, 1986 bp, Homo sapiens
gccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtccaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcatgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttaaaaaaagaca

SEQ ID NO: 425263 - DNA, 374 bp, Homo sapiens
ctttctacgaccgcttctccgagtaagcacccaggacaccctgagccagggagagggctggcaagcgggcactggtgctccggtccctgctggcgccttcccttccccacgcctcatccagggttcaccaagcactgtgtgttgtccgggtggcagtcaccagatgccagcccagtcccgcccgcagagctctctgggccatcaggccacttgagcaggaacttaaacattggttggcaggagaggcactgagggcagggctgagggcattgccaggtggcccacagggatggcgacagggcgggcgcccatggcctctagctcatttccacttcttcctgccaaatagtttggcttatcctcacttctcagag

SEQ ID NO: 425264 - DNA, 1393 bp, Homo sapiens
ataggcacccgccgccacactcagctacttttttttgtatgttagtagaggcggggtttcaccatgttggccaggctagtcttgaactcctgacctcgtgatccgcccgcctcagcctcccaaagtgctgggattacaggcatgagccactgcatccagcctaaaatacttgtttttaaaggagatcactgccttgtgtgagaattcttttaaattttttaaaaactgaagtgtgttttaaatacaaattctgtcatgattgtgttcatgtggttcatggtttcctagtgtctcccatgagatccataatgccactttctgtttacatgtcttgttgtttggttagtagtcatcagagactaatctattaaatatggagccctctccattttttttcaaaatgactgcattttaagtttcttaaattgtaaagtaaggtgggtacagtttcttctagttcttagatggtgctgtcacgggccagcataattgctaaaacatccatacgtatggtagaccttaagtcatgtgctaatcatgaaagctgggctcaccctgaataccggcagttgcctggtctttataatgattactgaatgcataaccagttacgcttgcatgtgttcatcatcataacttattttctaattatcttaattttcagaggttggaggtttgcaatgtccactcaagttgcaatgcaaaactctggctcatattcaatttctcagtttcaatccagaatgatcaggtaaatcaactgttttctttttatacttcgttaaaaggaaagtggggaggggggtggtaatttttacaggtttaatgtagttaaatgaatgtacctaaaggttgaagatttttgtttagttgcagaaaatagagtttaacgtctgtgtttaagataaatttaatgtctaaatgtattttatttgctgtataacactgaaagcactcattagaggaaatgttgagactgaattttttaatatgctgatctttattttctaactttctgtgctgattaaattttattatctgtattcatcagagcgtaggccatacaaatgaatttaaagacatttttctttgacatcctagacaaaaatagaaaagagagtcattaaaaaaaatttttaggttgtgtgtggtggctcacacctgtaatcccagcgctttgggaggccaaggcgagaggactgcttgagcccaggagtttgagaccagcctgggcaaaatggtgaaaccctgtctctacaaaaaatgcaaaaattagccaggtgtggtggcgtgtacacctgtggtcccagctacttggtgggatgaggtgggaagatcgcttgagcctgggagattgaagctacagtgagtgccactgcactccagcctgggt

SEQ ID NO: 425265 - DNA, 478 bp, Homo sapiens
tctatcacagggtaaaaaaattgattatttgagggaaaaaaaaaaggatttgtcttgtagccaggatattgttttaaagaaaatcctttttgtttttccaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccaggtatgtggataggcatgaaaaggttggcagtcccttggtggaactagaactatttcaatttagaaaaagttgaaggaaatgtatctgagccattcttcagcttcccattgtaggttagtctcgggtttgaacatgactttctctagtggaatgttgatgcaaaacttaagtcgatttgcaactttct

SEQ ID NO: 425266 - DNA, 4009 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425267 - DNA, 3955 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaattattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425268 - DNA, 4370 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaaaaaaaaaaaaaaaaaaaaaaaaaaaaaaaaaaaaaaaaaaaaaaaaaaaaaaaaaaaaaagagagggggggcgcgcgcccaaaaaaaaccccggagggggggccccatggcgcgcgccccccttttgggaaaagggggcgcccccaaaggggggggttaaagaggcagcagcgcgggcggcggcattaaaaacacacggcgagcgggcgaaacacgtgccccccgggggacccctgggggggaggaaaccactcaccgacggggagggcacaacatgtgcggcaccaaaccccacacgagataatagcggccgcgaggagacataacacagtacagagccggcatccgtgtgcacaacgtg

SEQ ID NO: 425269 - DNA, 4087 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaacctttatttttctcggtagcaccaatgaaaagaatagagaagacacagatgtgatagccttaatgcagcacttattaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425270 - DNA, 3745 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425271 - DNA, 3465 bp, Homo sapiens
gattgtgtcccctccccaccccccaccccccaaaaaaataggattgtcccgaaggttgatatacctatgggtggtgtgtgtatgcatgcatgtatatatacacacatatacgtaacatacaaatatgtatattgatcccagtaaagtagatgtgtgtgtatatttacatgaacaccctaaaaacaagatacattgaatatttgttaatattttatatatcaatgagtgatatttttaccttattttgtatctaaattaagttttatttggatgcatttttagcttactaactgtgcttgctctatgaaagcaatattgtctaccactttttattcaggtagtctacgtaagaataataagatattcactcaatcatacttataaaaaaaccattgggaaaaacagttcgtgaacaccatgcttttaacatgaaattctaatcatacacgtttgtggttttttgggcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425272 - DNA, 3482 bp, Homo sapiens
ataggcacccgccgccacactcagctacttttttttgtatgttagtagaggcggggtttcaccatgttggccaggctagtcttgaactcctgacctcgtgatccgcccgcctcagcctcccaaagtgctgggattacaggcatgagccactgcatccagcctaaaatacttgtttttaaaggagatcactgccttgtgtgagaattcttttaaattttttaaaaactgaagtgtgttttaaatacaaattctgtcatgattgtgttcatgtggttcatggtttcctagtgtctcccatgagatccataatgccactttctgtttacatgtcttgttgtttggttagtagtcatcagagactaatctattaaatatggagccctctccattttttttcaaaatgactgcattttaagtttcttaaattgtaaagtaaggtgggtacagtttcttctagttcttagatggtgctgtcacgggccagcataattgctaaaacatccatacgtatggtagaccttaagtcatgtgctaatcatgaaagctgggctcaccctgaataccggcagttgcctggtctttataatgattactgaatgcataaccagttacgcttgcatgtgttcatcatcataacttattttctaattatcttaattttcagaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425273 - DNA, 2739 bp, Homo sapiens
aagatagcagttattttaatgcttcattaacaattagcattttcttgaacggtataacatggcagttaaattacataaggaagcagacttgattttacatagtatacttagaaaagtgaaatccaagaatttaattttttaaccttgtctttagtttgacagtgagtgaaattaaaaaatttttttttccattcctagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425274 - DNA, 859 bp, Homo sapiens
agcagcagtcaagcagtacagcagctatcagagaaaagcttaaatataatgtgtatacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425275 - DNA, 1130 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcagatggagtctcgctctgtcgcccaggctagagtgcagtggcgcgatctcggctcactgcaagctccgcctcccgggttcacgccattctcctgcctcagtcgactgagtagctgggact

SEQ ID NO: 425276 - DNA, 948 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaagtaagttcagtgttacggttttttgttttgttttgttttgttttgttcccctcatgataaacatttagggattttaacactgtataaggtgaaggtattaaaaattcatgatgatattggcctcataaaatataacctttagtagtagtcatcacagaacagaaataggttgaggaaggggtgtaaattccctttctaaccacctatatgtccgtgtgaagtagagatccctgagtaaaccttctgaaactcag

SEQ ID NO: 425277 - DNA, 3955 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425278 - DNA, 4326 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaaaaaaaaaaaaaaaaaagagagggggggcgcgcgcccaaaaaaaaccccggagggggggccccatggcgcgcgccccccttttgggaaaagggggcgcccccaaaggggggggttaaagaggcagcagcgcgggcggcggcattaaaaacacacggcgagcgggcgaaacacgtgccccccgggggacccctgggggggaggaaaccactcaccgacggggagggcacaacatgtgcggcaccaaaccccacacgagataatagcggccgcgaggagacataacacagtacagagccggcatccgtgtgcacaacgtg

SEQ ID NO: 425279 - DNA, 4041 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaaaatttaatttacatacaatgctttttgactagtatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgtttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttcttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaa

SEQ ID NO: 425280 - DNA, 1920 bp, Homo sapiens
ttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtaaatcaactgttttctttttatacttcgttaaaaggaaagtggggaggggggtggtaatttttacaggtttaatgtagttaaatgaatgtacctaaaggttgaagatttttgtttagttgcagaaaatagagtttaacgtctgtgtttaagataaatttaatgtctaaatgtattttatttgctgtataacactgaaagcactcattagaggaaatgttgagactgaattttttaatatgctgatctttattttctaactttctgtgctgattaaattttattatctgtattcatcagagcgtaggccatacaaatgaatttaaagacatttttctttgacatcctagacaaaaatagaaaagagagtcattaaaaaaaatttttaggttgtgtgtggtggctcacacctgtaatcccagcgctttgggaggccaaggcgagaggactgcttgagcccaggagtttgagaccagcctgggcaaaatggtgaaaccctgtctctacaaaaaatgcaaaaattagccaggtgtggtggcgtgtacacctgtggtcccagctacttggtgggatgaggtgggaagatcgcttgagcctgggagattgaagctacagtgagtgccactgcactccagcctgggt

SEQ ID NO: 425281 - DNA, 5651 bp, Homo sapiens
acacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaatatttgaaatatttctttttgtttatacatgcattttttttgaataatgagataggtgttcttatacagaattgttgagtgttttgctggatacaaacagaaaagcagtgagaccagaaggtctctgggggaggtgacaacccaacagaggaggtggaacatcacagacactggatggcaccatctacaagggcacgtggaaaaacaagtccacatcgtgtcctatggactttggaataaaatacgaataacctatcgcctggcggttcagatgacgtggcatgtggagagacgtgagaacttcttacaggcatggatgaaatacagggagagaagaatcgagactcatccctgaaacatggcaccttccatgtggctactctactccttggggcccgcttctgttatggaccgcatcttaaaaagctccacaggggtagatctgatggctctcataccctcatactttaagttccagataatcacagaagccccagccctaaattatttccactttatttttactatcagtggggagagaaacaaattactgcttggtctgtcagttggaaacaacctcaatgcgatctgctttctgccatcctactatttctgaagaatcttgattgaactcttgcttttcctgtgggggtgactgtatattccttaggagaatcacagtgaaaaggagacgtttctgtgtctccgtctttctccccacccaccactggcaccctgctctgtggtggcatcttaggaggagaggggaaagagtggctttcttggttctgccgtagtaggggttcagcctgcatgcgatgctgattccatcatcaaatgagcacagcagcataatttgctttggcagatgtgaggatgttgttgggggaatggagggtcatttgaatgaaacatggacctgattgttgcaccactttccttaataagccactcggtaactgtaatacagtttctctcagttgcctgctctgacctaccttccacagcggccagcctttattcacagaacaagaggtagagcaatctgtagtcatttgttcagcaatgggggaaaaaaagtcctaataaatgct

SEQ ID NO: 425282 - DNA, 4557 bp, Homo sapiens
acacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaa

SEQ ID NO: 425283 - DNA, 5452 bp, Homo sapiens
acacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccatggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaatatttgaaatatttctttttgtttatacatgcattttttttgaataatgagataggtgttcttatacagaattgttgagtgttttgctggatacaaacagaaaagcagtgagaccagaaggtctctgggggaggtgacaacccaacagaggaggtggaacatcacagacactggatggcaccatctacaagggcacgtggaaaaacaagtccacatcgtgtcctatggactttggaataaaatacgaataacctatcgcctggcggttcagatgacgtggcatgtggagagacgtgagaacttcttacaggcatggatgaaatacagggagagaagaatcgagactcatccctgaaacatggcaccttccatgtggctactctactccttggggcccgcttctgttatggaccgcatcttaaaaagctccacaggggtagatctgatggctctcataccctcatactttaagttccagataatcacagaagccccagccctaaattatttccactttatttttactatcagtggggagagaaacaaattactgcttggtctgtcagttggaaacaacctcaatgcgatctgctttctgccatcctactatttctgaagaatcttgattgaactcttgcttttcctgtgggggtgactgtatattccttaggagaatcacagtgaaaaggagacgtttctgtgtctccgtctttctccccacccaccactggcaccctgctctgtggtggcatcttaggaggagaggggaaagagtggctttcttggttctgccgtagtaggggttcagcctgcatgcgatgctgattccatcatcaaatgagcacagcagcataatttgctttggcagatgtgaggatgttgttgggggaatggagggtcatttgaatgaaacatggacctgattgttgcaccactttccttaataagccactcggtaactgtaatacagtttctctcagttgcctgctctgacctaccttccacagcggccagcctttattcacagaacaagaggtagagcaatctgtagtcatttgttcagcaatgggggaaaaaaagtcctaataaatgct

SEQ ID NO: 425284 - DNA, 4923 bp, Homo sapiens
  misc_feature (86)..(86): n is a, c, g, or t
  misc_feature (271)..(271): n is a, c, g, or t
tttctttgattgccccttcgtcttccccaccccaccccacccctcacattttcttgatcagtgcaaggtttgctgagtcgatcatnaagcagggtctggcatggagggttcgcctttgttttctggaaggctggattttagaagttggcacatggtcctggaagagctgaggaagactggtctgacggcaacttctagaataactgagaatgtgaagctgaggagttgttctaggacctggagtggggtacatcttagtacaggggatatnctggcatggaacaagaaaaggaagcatagaaagaaaggagggtcagcatgtgaaattcactccggatcagcccgtctaggagagatcaaggaaaactggccattattaaaacttttggtcctgtccaaagtaagttaatagtgtctaagatttgtttcaaatagggagggtggagacaaaagaagggtgaccgtaattaatgattatcataggtgagttatgggctcatgcggtcttgcagtgagctgttctcttttgtgtgggtgtttgaaattttccaaagttaaaaataaattatttgccaggcacagtggctcacgcctataatcccagcactttgggaggccgaggcaggcagatcacctgaggtcaggagtttgagaccagcctgggcaacatggcaaaaccccgtctctactaaaaatacaaaaattagctgggctgggcatggtggcaggtgcctgtaatcccagctacttgggaggctgaggcagggagaatcgcttgaatccgggaggcagaggttgcaatgagctgagattgcgctattgcactccagcctgagcgacagagtgagtctcaaaaaaataaaataaattatgcatttattactttttctttttttttgaatagagataaggtcttactgtgttgcccaggctggtctcgaactcctaagctcaagtgatcctcccaccgtggcctcccaaaatgctgggattacaggtgtgagccactgtgcccagtcaaaaataaattttttgaaagtgaatcttaagtagatggtgacctgaagatgcgataagagcagagtggttgtggctgacagcctgtggtcccgtgggaattaacctttttcttaatgttattaaatctcagatccaaaaggaaagtcctcggccgtagagattcagatgatgaccactcccgaaaccattctccctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaatatttgaaatatttctttttgtttatacatgcattttttttgaataatgagataggtgttcttatacagaattgttgagtgttttgctggatacaaacagaaaagcagtgagaccagaaggtctctgggggaggtgacaacccaacagaggaggtggaacatcacagacactggatggcaccatctacaagggcacgtggaaaaacaagtccacatcgtgtcctatggactttggaataaaatacgaataacctatcgcctggcggttcagatgacgtggcatgtggagagacgtgagaacttcttacaggcatggatgaaatacagggagagaagaatcgagactcatccctgaaacatggcaccttccatgtggctactctactccttggggcccgcttctgttatggaccgcatcttaaaaagctccacaggggtagatctgatggctctcataccctcatactttaagttccagataatcacagaagccccagccctaaattatttccactttatttttactatcagtggggagagaaacaaattactgcttggtctgtcagttggaaacaacctcaatgcgatctgctttctgccatcctactatttctgaagaatcttgattgaactcttgcttttcctgtgggggtgactgtatattccttaggagaatcacagtgaaaaggagacgtttctgtgtctccgtctttctccccacccaccactggcaccctgctctgtggtggcatcttaggaggagaggggaaagagtggctttcttggttctgccgtagtaggggttcagcctgcatgcgatgctgattccatcatcaaatgagcacagcagcataatttgctttggcagatgtgaggatgttgttgggggaatggagggtcatttgaatgaaacatggacctgattgttgcaccactttccttaataagccactcggtaactgtaatacagtttctctcagttgcctgctctgacctaccttccacagcggccagcctttattcacagaacaagaggtagagcaatctgtagtcatttgttcagcaatgggggaaaaaaagtcctaataaatgct

SEQ ID NO: 425285 - DNA, 2771 bp, Homo sapiens
  misc_feature (86)..(86): n is a, c, g, or t
  misc_feature (271)..(271): n is a, c, g, or t
tttctttgattgccccttcgtcttccccaccccaccccacccctcacattttcttgatcagtgcaaggtttgctgagtcgatcatnaagcagggtctggcatggagggttcgcctttgttttctggaaggctggattttagaagttggcacatggtcctggaagagctgaggaagactggtctgacggcaacttctagaataactgagaatgtgaagctgaggagttgttctaggacctggagtggggtacatcttagtacaggggatatnctggcatggaacaagaaaaggaagcatagaaagaaaggagggtcagcatgtgaaattcactccggatcagcccgtctaggagagatcaaggaaaactggccattattaaaacttttggtcctgtccaaagtaagttaatagtgtctaagatttgtttcaaatagggagggtggagacaaaagaagggtgaccgtaattaatgattatcataggtgagttatgggctcatgcggtcttgcagtgagctgttctcttttgtgtgggtgtttgaaattttccaaagttaaaaataaattatttgccaggcacagtggctcacgcctataatcccagcactttgggaggccgaggcaggcagatcacctgaggtcaggagtttgagaccagcctgggcaacatggcaaaaccccgtctctactaaaaatacaaaaattagctgggctgggcatggtggcaggtgcctgtaatcccagctacttgggaggctgaggcagggagaatcgcttgaatccgggaggcagaggttgcaatgagctgagattgcgctattgcactccagcctgagcgacagagtgagtctcaaaaaaataaaataaattatgcatttattactttttctttttttttgaatagagataaggtcttactgtgttgcccaggctggtctcgaactcctaagctcaagtgatcctcccaccgtggcctcccaaaatgctgggattacaggtgtgagccactgtgcccagtcaaaaataaattttttgaaagtgaatcttaagtagatggtgacctgaagatgcgataagagcagagtggttgtggctgacagcctgtggtcccgtgggaattaacctttttcttaatgttattaaatctcagatccaaaaggaaagtcctcggccgtagagattcagatgatgaccactcccgaaaccattctccctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggacccaatgtagccataatccctaggatccaactattttccgggcaattcattaaaagccttcttttcaaataaatggcatcatacaat

SEQ ID NO: 425286 - DNA, 4631 bp, Homo sapiens
acacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaaaacctcaaacttgaagcttaaaaacgaaggcggcccctaggcttattcccctttagtgaagggataaatttaag

SEQ ID NO: 425287 - DNA, 4976 bp, Homo sapiens
  misc_feature (86)..(86): n is a, c, g, or t
  misc_feature (271)..(271): n is a, c, g, or t
tttctttgattgccccttcgtcttccccaccccaccccacccctcacattttcttgatcagtgcaaggtttgctgagtcgatcatnaagcagggtctggcatggagggttcgcctttgttttctggaaggctggattttagaagttggcacatggtcctggaagagctgaggaagactggtctgacggcaacttctagaataactgagaatgtgaagctgaggagttgttctaggacctggagtggggtacatcttagtacaggggatatnctggcatggaacaagaaaaggaagcatagaaagaaaggagggtcagcatgtgaaattcactccggatcagcccgtctaggagagatcaaggaaaactggccattattaaaacttttggtcctgtccaaagtaagttaatagtgtctaagatttgtttcaaatagggagggtggagacaaaagaagggtgaccgtaattaatgattatcataggtgagttatgggctcatgcggtcttgcagtgagctgttctcttttgtgtgggtgtttgaaattttccaaagttaaaaataaattatttgccaggcacagtggctcacgcctataatcccagcactttgggaggccgaggcaggcagatcacctgaggtcaggagtttgagaccagcctgggcaacatggcaaaaccccgtctctactaaaaatacaaaaattagctgggctgggcatggtggcaggtgcctgtaatcccagctacttgggaggctgaggcagggagaatcgcttgaatccgggaggcagaggttgcaatgagctgagattgcgctattgcactccagcctgagcgacagagtgagtctcaaaaaaataaaataaattatgcatttattactttttctttttttttgaatagagataaggtcttactgtgttgcccaggctggtctcgaactcctaagctcaagtgatcctcccaccgtggcctcccaaaatgctgggattacaggtgtgagccactgtgcccagtcaaaaataaattttttgaaagtgaatcttaagtagatggtgacctgaagatgcgataagagcagagtggttgtggctgacagcctgtggtcccgtgggaattaacctttttcttaatgttattaaatctcagatccaaaaggaaagtcctcggccgtagagattcagatgatgaccactcccgaaaccattctccctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaatatttgaaatatttctttttgtttatacatgcattttttttgaataatgagataggtgttcttatacagaattgttgagtgttttgctggatacaaacagaaaagcagtgagaccagaaggtctctgggggaggtgacaacccaacagaggaggtggaacatcacagacactggatggcaccatctacaagggcacgtggaaaaacaagtccacatcgtgtcctatggactttggaataaaatacgaataacctatcgcctggcggttcagatgacgtggcatgtggagagacgtgagaacttcttacaggcatggatgaaatacagggagagaagaatcgagactcatccctgaaacatggcaccttccatgtggctactctactccttggggcccgcttctgttatggaccgcatcttaaaaagctccacaggggtagatctgatggctctcataccctcatactttaagttccagataatcacagaagccccagccctaaattatttccactttatttttactatcagtggggagagaaacaaattactgcttggtctgtcagttggaaacaacctcaatgcgatctgctttctgccatcctactatttctgaagaatcttgattgaactcttgcttttcctgtgggggtgactgtatattccttaggagaatcacagtgaaaaggagacgtttctgtgtctccgtctttctccccacccaccactggcaccctgctctgtggtggcatcttaggaggagaggggaaagagtggctttcttggttctgccgtagtaggggttcagcctgcatgcgatgctgattccatcatcaaatgagcacagcagcataatttgctttggcagatgtgaggatgttgttgggggaatggagggtcatttgaatgaaacatggacctgattgttgcaccactttccttaataagccactcggtaactgtaatacagtttctctcagttgcctgctctgacctaccttccacagcggccagcctttattcacagaacaagaggtagagcaatctgtagtcatttgttcagcaatgggggaaaaaaagtcctaataaatgct

SEQ ID NO: 425288 - DNA, 4922 bp, Homo sapiens
  misc_feature (86)..(86): n is a, c, g, or t
  misc_feature (271)..(271): n is a, c, g, or t
tttctttgattgccccttcgtcttccccaccccaccccacccctcacattttcttgatcagtgcaaggtttgctgagtcgatcatnaagcagggtctggcatggagggttcgcctttgttttctggaaggctggattttagaagttggcacatggtcctggaagagctgaggaagactggtctgacggcaacttctagaataactgagaatgtgaagctgaggagttgttctaggacctggagtggggtacatcttagtacaggggatatnctggcatggaacaagaaaaggaagcatagaaagaaaggagggtcagcatgtgaaattcactccggatcagcccgtctaggagagatcaaggaaaactggccattattaaaacttttggtcctgtccaaagtaagttaatagtgtctaagatttgtttcaaatagggagggtggagacaaaagaagggtgaccgtaattaatgattatcataggtgagttatgggctcatgcggtcttgcagtgagctgttctcttttgtgtgggtgtttgaaattttccaaagttaaaaataaattatttgccaggcacagtggctcacgcctataatcccagcactttgggaggccgaggcaggcagatcacctgaggtcaggagtttgagaccagcctgggcaacatggcaaaaccccgtctctactaaaaatacaaaaattagctgggctgggcatggtggcaggtgcctgtaatcccagctacttgggaggctgaggcagggagaatcgcttgaatccgggaggcagaggttgcaatgagctgagattgcgctattgcactccagcctgagcgacagagtgagtctcaaaaaaataaaataaattatgcatttattactttttctttttttttgaatagagataaggtcttactgtgttgcccaggctggtctcgaactcctaagctcaagtgatcctcccaccgtggcctcccaaaatgctgggattacaggtgtgagccactgtgcccagtcaaaaataaattttttgaaagtgaatcttaagtagatggtgacctgaagatgcgataagagcagagtggttgtggctgacagcctgtggtcccgtgggaattaacctttttcttaatgttattaaatctcagatccaaaaggaaagtcctcggccgtagagattcagatgatgaccactcccgaaaccattctccctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaatatttgaaatatttctttttgtttatacatgcattttttttgaataatgagataggtgttcttatacagaattgttgagtgttttgctggatacaaacagaaaagcagtgagaccagaaggtctctgggggaggtgacaacccaacagaggaggtggaacatcacagacactggatggcaccatctacaagggcacgtggaaaaacaagtccacatcgtgtcctatggactttggaataaaatacgaataacctatcgcctggcggttcagatgacgtggcatgtggagagacgtgagaacttcttacaggcatggatgaaatacagggagagaagaatcgagactcatccctgaaacatggcaccttccatgtggctactctactccttggggcccgcttctgttatggaccgcatcttaaaaagctccacaggggtagatctgatggctctcataccctcatactttaagttccagataatcacagaagccccagccctaaattatttccactttatttttactatcagtggggagagaaacaaattactgcttggtctgtcagttggaaacaacctcaatgcgatctgctttctgccatcctactatttctgaagaatcttgattgaactcttgcttttcctgtgggggtgactgtatattccttaggagaatcacagtgaaaaggagacgtttctgtgtctccgtctttctccccacccaccactggcaccctgctctgtggtggcatcttaggaggagaggggaaagagtggctttcttggttctgccgtagtaggggttcagcctgcatgcgatgctgattccatcatcaaatgagcacagcagcataatttgctttggcagatgtgaggatgttgttgggggaatggagggtcatttgaatgaaacatggacctgattgttgcaccactttccttaataagccactcggtaactgtaatacagtttctctcagttgcctgctctgacctaccttccacagcggccagcctttattcacagaacaagaggtagagcaatctgtagtcatttgttcagcaatgggggaaaaaaagtcctaataaatgct

SEQ ID NO: 425289 - DNA, 2646 bp, Homo sapiens
  misc_feature (2635)..(2636): n is a, c, g, or t
  misc_feature (2639)..(2639): n is a, c, g, or t
  misc_feature (2643)..(2643): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425290 - DNA, 547 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgcactcttctaaagagcatagctcaaaaattgtatacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgtta

SEQ ID NO: 425291 - DNA, 2933 bp, Homo sapiens
  misc_feature (2922)..(2923): n is a, c, g, or t
  misc_feature (2926)..(2926): n is a, c, g, or t
  misc_feature (2930)..(2930): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggtgagtctttgctcgtggtggtgtggagagggtgcccttgtgggctttgccttagaggagggctgggaaaactacagcccatgggccatatccaacccagcacctgaatttgtacagctcccgagggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425292 - DNA, 2930 bp, Homo sapiens
  misc_feature (2919)..(2920): n is a, c, g, or t
  misc_feature (2923)..(2923): n is a, c, g, or t
  misc_feature (2927)..(2927): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggagcaggggagagaagacagaagaggttggagaggtcagggaggtgccagatcatggaggccctcgtgtgctgccacgagttgattctaagagtagcgtggagccattggaggggcctaactggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425293 - DNA, 2998 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggtgagtctttgctcgtggtggtgtggagagggtgcccttgtgggctttgccttagaggagggctgggaaaactacagcccatgggccatatccaacccagcacctgaatttgtacagctcccgagggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataatttggttttccgggggaatcgagggggggcccggtcccaattcgccctataggagtgtatacaattactggcccgcgttacaacgtgggactgggaaccctgcgttcc

SEQ ID NO: 425294 - DNA, 2982 bp, Homo sapiens
  misc_feature (2971)..(2972): n is a, c, g, or t
  misc_feature (2975)..(2975): n is a, c, g, or t
  misc_feature (2979)..(2979): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgaggctgggacagggccgaggcctagggattttaagttctgggatccaggtgggggctgggggcttcccagtaagggctgtgctcacacatccctggaggctctgacctcccttctggctgtcactcccatccggaggtgggacttaggccgaatggtcatgtcaggaagagcgtctgggtggagggtggagaccacaggaatgaagagggggttgctggatggagcctggcctggcagagccacacaggagagactccacagctctagagggtcaccaccttctccctgccatggggaggggccaggctgggtgactgccccagccccgccccagggccagcacctgccccactccaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425295 - DNA, 2858 bp, Homo sapiens
  misc_feature (2847)..(2848): n is a, c, g, or t
  misc_feature (2851)..(2851): n is a, c, g, or t
  misc_feature (2855)..(2855): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagctcctgaaaataaaccctgtgctaactggctcctgctgtactggctttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425296 - DNA, 2646 bp, Homo sapiens
  misc_feature (2635)..(2636): n is a, c, g, or t
  misc_feature (2639)..(2639): n is a, c, g, or t
  misc_feature (2643)..(2643): n is a, c, g, or t
attttaacaggactctccggcagctaggtggaaatggacggtagggggcaaaaagagaagcaaggaggcccaggaggaggctggttcaagacccctgagatgatggagcactgatggagctggagcgggatggggccggaggaggtgagggatgagattctgcaagtggagcccgcaggatctgctgatcgatgggacgaggaacgggagaaaaattaaagcggcgcatgaggcagacgaatgcaaacttcaccaatagctcaacgaaaagacagacggtgaccgctgagaggcagcgtcggatctggtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425297 - DNA, 1996 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtgggcgggaaagtccctggacagacacctgcagaccgcacgggggaggtgtaggccaggaagggagacacctgcgcactgccgcgcctctccgttactgccttgcccctcccaaccatgctgctggcagtgaccctgcacctggctgtgacctgccctctctcaaaggtcaccctgtggctgagacccgctccctggctgtggcgcacatccaggttcacatgccccactcccacgtgggctgtggctccatccccagctttgacacaccacacgagtatggctggccatgaccccagcaccctagccatgaccccagcaccctagccatgaccacacctcagctcggacctcacccccacccgtctgtgacctaagcctgctccacctcgccgtgacctcaccctggactctcctactcctgacctcttccctctcgggctgggcccacccctgacttcctgagagcctggcctggaccctcgctgcgccctagggggatgacccccgaccccggtcctacgc

SEQ ID NO: 425298 - DNA, 2467 bp, Homo sapiens
  misc_feature (2456)..(2457): n is a, c, g, or t
  misc_feature (2460)..(2460): n is a, c, g, or t
  misc_feature (2464)..(2464): n is a, c, g, or t
attttaacaggactctccggcagctaggtggaaatggacggtagggggcaaaaagagaagcaaggaggcccaggaggaggctggttcaagacccctgagatgatggagcactgatggagctggagcgggatggggccggaggaggtgagggatgagattctgcaagtggagcccgcaggatctgctgatcgatgggacgaggaacgggagaaaaattaaagcggcgcatgaggcagacgaatgcaaacttcaccaatagctcaacgaaaagacagacggtgaccgctgagaggcagcgtcggatctgggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425299 - DNA, 1828 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtcaccctgtggctgagacccgctccctggctgtggcgcacatccaggttcacatgccccactcccacgtgggctgtggctccatccccagctttgacacaccacacgagtatggctggccatgaccccagcaccctagccatgaccccagcaccctagccatgaccacacctcagctcggacctcacccccacccgtctgtgacctaagcctgctccacctcgccgtgacctcaccctggactctcctactcctgacctcttccctctcgggctgggcccacccctgacttcctgagagcctggcctggaccctcgctgcgccctagggggatgacccccgaccccggtcctacgc

SEQ ID NO: 425300 - DNA, 1948 bp, Homo sapiens
  misc_feature (1937)..(1938): n is a, c, g, or t
  misc_feature (1941)..(1941): n is a, c, g, or t
  misc_feature (1945)..(1945): n is a, c, g, or t
tgagcccctgctgttctctgcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425301 - DNA, 2301 bp, Homo sapiens
  misc_feature (2290)..(2291): n is a, c, g, or t
  misc_feature (2294)..(2294): n is a, c, g, or t
  misc_feature (2298)..(2298): n is a, c, g, or t
atcccagaatcggcttgactgaatcacgccgctggctttgaaattggagaaaacggcttatgggctaaggagttcagggcactctaactggaacagaacgaggaaatggattcagtcttagagcctccagaaggaatgcagccctgctgacatcttcattttagttcaatgaaacccattttggatttctgatctccagaactgtaaagtaatatatttgtgccattttcagcactgagtttgtgataatttgttacggcagcaacaggaaactagtacactaaggaaaaagcctctgacatgaagagcaaagttttatgctgaggagacaagatctgaaagtcagcacctgttggaggtagaggcctgcagaggcctaatgaacattcgaggttcttggttgaaagacttggggggctacaattaagaaacaagggggccaggcacagtggcgtctctctaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425302 - DNA, 1296 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcagattcctcatggtgcaaaatggccattccagctccatccagccatcacatcacaggaggaagggaagaaagacacccctccacactcttctaaagagcatagctcaaaaattgtatacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgtttgccacgctgggtgtttgcctcataaacttgtgctttcgttacacaaaaacaaccccggttcttgtggacacggaaaggcaggccagtcacccttgaagggaaccgccaaggtaaagaaaaaaaa

SEQ ID NO: 425303 - DNA, 1286 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagctcctgaaaataaaccctgtgctaactggctcctgctgtactggctttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcagattcctcatggtgcaaaatggccattccagctccatccagccatcacatcacaggaggaagggaagaaagacacccctccacactcttctaaagagcatagctcaaaaattgtatacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgtta

SEQ ID NO: 425304 - DNA, 1090 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagattcctcatggtgcaaaatggccattccagctccatccagccatcacatcacaggaggaagggaagaaagacacccctccacactcttctaaagagcatagctcaaaaattgtatacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgtta

SEQ ID NO: 425305 - DNA, 1237 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagattcctcatggtgcaaaatggccattccagctccatccagccatcacatcacaggaggaagggaagaaagacacccctccacactcttctaaagagcatagctcaaaaattgtatacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgttaaaaaaaaaaaaagggggggtaaaattccggggcaagtacggttccggtttgcaagggcaagggggtttagaggggggggtaagggggggaagtggtttgggacttggtggtgggcccgtagcggaatagggggggttgcggttgtac

SEQ ID NO: 425306 - DNA, 440 bp, Homo sapiens
  misc_feature (429)..(430): n is a, c, g, or t
  misc_feature (433)..(433): n is a, c, g, or t
  misc_feature (437)..(437): n is a, c, g, or t
ctgagatagactctaggggccagatggatgcagggagcccagcgaggaggctcctggagtcacccaggtgggggatgtggggcctggaccagagaatcagagcggcagtatggaggcagggtggaggccttggtgatgggttggtgagagggatgggaaggaaggagatattgaggagaagtccacctggggtgactgagtgaggcccctggggtcaggccttgccatgtgagggatggagtccccagtgaagggggttcctatgatcctaactcttttcccctcccctcccctagggagtgcctgcagggcaccatccgcaacagccaggaggcggaggtctcctgccccttcattgacaacacctactctctgcagcctgtgtaagctattataattaaaatggttttccgggaaaaaaaaaaactnntgncctngag

SEQ ID NO: 425307 - DNA, 172 bp, Homo sapiens
agtgcatggctggcctgaacccaagggacagcaggacaggatattcttgcctgtagaacagttcttcctaatggcacgttctggcttcaggaggcctggcttctaaccctagttatgtcattaatcaactgtgaaatacagagcaggtcacttcacctctcagtgtgtcctc

SEQ ID NO: 425308 - DNA, 2662 bp, Homo sapiens
  misc_feature (2651)..(2652): n is a, c, g, or t
  misc_feature (2655)..(2655): n is a, c, g, or t
  misc_feature (2659)..(2659): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425309 - DNA, 2807 bp, Homo sapiens
  misc_feature (2796)..(2797): n is a, c, g, or t
  misc_feature (2800)..(2800): n is a, c, g, or t
  misc_feature (2804)..(2804): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425310 - DNA, 3168 bp, Homo sapiens
  misc_feature (3157)..(3158): n is a, c, g, or t
  misc_feature (3161)..(3161): n is a, c, g, or t
  misc_feature (3165)..(3165): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgaggctgggacagggccgaggcctagggattttaagttctgggatccaggtgggggctgggggcttcccagtaagggctgtgctcacacatccctggaggctctgacctcccttctggctgtcactcccatccggaggtgggacttaggccgaatggtcatgtcaggaagagcgtctgggtggagggtggagaccacaggaatgaagagggggttgctggatggagcctggcctggcagagccacacaggagagactccacagctctagagggtcaccaccttctccctgccatggggaggggccaggctgggtgactgccccagccccgccccagggccagcacctgccccactccaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425311 - DNA, 2501 bp, Homo sapiens
  misc_feature (2490)..(2491): n is a, c, g, or t
  misc_feature (2494)..(2494): n is a, c, g, or t
  misc_feature (2498)..(2498): n is a, c, g, or t
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425312 - DNA, 2563 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgggtggcaaggaatcccatttaccctgcagcggcagcccccgttggtgtctcctgggcccccagggccccagcgtgggcccttggtgacccagcagatctcggtgtggcagacgtgcagcggacccagaccagccttcga

SEQ ID NO: 425313 - DNA, 1235 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcagattcctcatggtgcaaaatggccattccagctccatccagccatcacatcacaggaggaagggaagaaagacacccctccacactcttctaaagagcatagctcaaaaattgtatacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgtta

SEQ ID NO: 425314 - DNA, 2516 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtctttgtgaattgtgtcaaatgctacatacagtacattaagagacaacaggagtccttcccagagagggtggtctggaagcttccaaggaggtagccccagagcagggaccggaaggcctgctgtaggtgtggggtgtgggcctggcctgttggaggagactgaggaggtctcttggtggctggagcagagggatgaagggggtaatcagagcaggatagagaggtgttgggtacgtgagcagcagtgaggagttgggatttgttctgggtaggatgggagtcactggggagacatggctgttgcgacgcgggctctggagcttgtcaccattggacagtctccctgatggaccctcagtcttctcatgaataaattccttcaacgccaaa

SEQ ID NO: 425315 - DNA, 2141 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtgggcgggaaagtccctggacagacacctgcagaccgcacgggggaggtgtaggccaggaagggagacacctgcgcactgccgcgcctctccgttactgccttgcccctcccaaccatgctgctggcagtgaccctgcacctggctgtgacctgccctctctcaaaggtcaccctgtggctgagacccgctccctggctgtggcgcacatccaggttcacatgccccactcccacgtgggctgtggctccatccccagctttgacacaccacacgagtatggctggccatgaccccagcaccctagccatgaccccagcaccctagccatgaccacacctcagctcggacctcacccccacccgtctgtgacctaagcctgctccacctcgccgtgacctcaccctggactctcctactcctggcctgttggaggagactgaggaggtctcttggtggctggagcagagggatgaagggggtaatcagagcaggatagagaggtgttgggtacgtgagcagcagtgaggagttgggatttgttctgggtaggatgggagtcactggggagacatggctgttgcgacgcgggctctggagcttgtcaccattggacagtctccctgatggaccctcagtcttctcatgaataaattccttcaacgccaaa

SEQ ID NO: 425316 - DNA, 2014 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtgggcgggaaagtccctggacagacacctgcagaccgcacgggggaggtgtaggccaggaagggagacacctgcgcactgccgcgcctctccgttactgccttgcccctcccaaccatgctgctggcagtgaccctgcacctggctgtgaccctgcacctggctgtgacctgccctctctcaaaggtcaccctgtggctgagacccgctccctggctgtggcgcacatccaggttcacatgccccactcccacgtgggctgtggctccatccccagctttgacacaccacacgagtatggctggccatgaccccagcaccctagccatgaccccagcaccctagccatgaccacacctcagctcggacctcacccccacccgtctgtgacctaagcctgctccacctcgccgtgacctcaccctggactctcctactcctgacctcttccctctcgggctgggcccacccctgacttcctgagagcctggcctggaccctcgctgcgccctagggggatgacccccgaccccggtcctacgc

SEQ ID NO: 425317 - DNA, 2060 bp, Homo sapiens
  misc_feature (2049)..(2050): n is a, c, g, or t
  misc_feature (2053)..(2053): n is a, c, g, or t
  misc_feature (2057)..(2057): n is a, c, g, or t
gccagatctcacgaggactcactatggcgagaagtcactacagtgagcgcagcaccaggctgtgagggagctgcccctatgacccaaacacctcccaccaggcctcaccttcaacactgaggattacagttcaaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425318 - DNA, 1347 bp, Homo sapiens
  misc_feature (12)..(12): n is a, c, g, or t
  misc_feature (1336)..(1337): n is a, c, g, or t
  misc_feature (1340)..(1340): n is a, c, g, or t
  misc_feature (1344)..(1344): n is a, c, g, or t
tggggtttctgnattattcaacctagttgcccttcgcactgactccgactcttgaggatacccggacgagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425319 - DNA, 1471 bp, Homo sapiens
  misc_feature (1460)..(1461): n is a, c, g, or t
  misc_feature (1464)..(1464): n is a, c, g, or t
  misc_feature (1468)..(1468): n is a, c, g, or t
ctgagatagactctaggggccagatggatgcagggagcccagcgaggaggctcctggagtcacccaggtgggggatgtggggcctggaccagagaatcagagcggcagtatggaggcagggtggaggccttggtgatgggttggtgagagggatgggaaggaaggagatattgaggagaagtccacctggggtgactgagtgaggcccctggggtcaggccttgccatgtgagggatggagtccccagtgaagggggttcctatgatcctaactcttttcccctcccctcccctagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaaaaaaaaaaactnntgncctngag

SEQ ID NO: 425320 - DNA, 1554 bp, Homo sapiens
ccgcccaccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggtgaggagtgcatggctggcctgaacccaagggacagcaggacaggatattcttgcctgtagaacagttcttcctaatggcacgttctggttcacctctcagtgtgtcctcattttaaaaatcagaccgtaacagtagctatctcatagggttgttaggaggtgtactgtattaggatgttaggccttatacaacagaagaaaacggaacagtgacgtaaacaaatttgatggcagggagtccagatagggaggttctgctcccgacagtcctcagaggctcatattgtttctctcaccattctgccattcattcccagattcctcatggtgcaaaatggccattccagctccatccagccatcacatcacaggaggaagggaagaaagacacccctccacactcttctaaagagcatagctcaaaaattgtatacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgtta

SEQ ID NO: 425321 - DNA, 1099 bp, Homo sapiens
agtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagacatgatccgccactacgtgtccatcctgctggagagcgacaagaagctcacccaggaacaagtatctgacaggggacgaggcacccacagtccctctcccataagcctgccaagaagattgatgtggcccgtgtaacctttgacctgtacaagctgaacccacaggacttcattggctgcctgaacatgaaggcgactttttatgatacgtactccctttcctatgatctgcactgctgtggggccaaacgcatcatgaaggaagctctccactgggcccttttcagcatgcaagccacgggccacgtgctgcttcacctcctgttacctgcagcagctcctcgatgccacagaggacgggcatccccccaagggcaaggcctcatccctcatcccgacctgtctgaagatactgcagtgaaagcccaagccctagctttccccagtgaaggactagactaggggccccacgctcaactggtagtggccacaagcctggcagctgtagagccgctaacctcccgacacctccctcaccacacaggaccctgagtgaggaggaggggctggaaacctggggtgggttggccaaaggagaacctcaggctcctggcctggcccagctccttcctgcccaaggtagcttagcccatccagactggtcctgaagtctgtccctccattggcatgaagtctgcccctcagcagtccggcctcacaggctgtactttcatggtgctctctaccttctggcccccatcccagaacattcgtgagtgaattcgcaagcatactagcatgtgatattagggagtttgcaataaattattgatgctgatgta

SEQ ID NO: 425322 - DNA, 1130 bp, Homo sapiens
agtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagacatgatccgccactacgtgtccatcctgctggagagcgacaagaagctcacccaggaacaagtatctgacaggggacgaggcacccacagtccctctcccataagcctgccaagaagattgatgtggcccgtgtaacctttgacctgtacaagctgaacccacaggacttcattggctgcctgaacatgaaggcgactttttatgatacgtactccctttcctatgatctgcactgctgtggggccaaacgcatcatgaagtgagcaaattggggtttcctggggacaaggtgggtacgggcaatgggagagcccctgtctgttcacatggactcagccttctcagcacctgggtctggctttggtgctgacaaagcatagcctgtatcagacaacacggagcctgatgggctctcgaagtgctgtggacaacactggcgtgtgcccaggggtgcacatgttcctcctggtggaacctggatgcattttatttttatgactactttccactctagcaactacattttttcattgaaataggaagttttcctaagtagtcttctagtcagttttttaaaaatgaacatgtgttggccaggcatagtggctcacgcctctaatcccagcactttgggaggccaaggtgggtggatcacttgaggtcaggagtttgagaccagcctggccaacatggcaaaacccaatctctacaaaaattagctggacatggcagtgcatgcctgtaatcccaactactcaggagcctgaggcaggagaatcgtttgaacccaggaggtggaggtgacagtgaggcgagattgtgtcactgcactccagcctgggcaaaacagcaagtgtcttaccaaaaaaaaa

SEQ ID NO: 425323 - DNA, 1817 bp, Homo sapiens
agtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagacatgatccgccactacgtgtccatcctgctggagagcgacaagaagctcacccaggaacaagtatctgacaggggacgaggcacccacagtccctctcccataagcctgccaagaagattgatgtggcccgtgtaacctttgacctgtacaagctgaacccacaggacttcattggctgcctgaacatgaaggcgactttttatgatacgtactccctttcctatgatctgcactgctgtggggccaaacgcatcatgaagtgagcaaattggggtttcctggggacaaggagctcgaggctaatggagtcaaagcagctgtggtcagtgaacaggaaaaggcagcctttgatgaggctggggggctggggagggaagattccaaacagcaaaggagcttgagcctcagtagggcctggcgatcctagtgggagaatggcctttcctggagacccccccgcacagccaggagcagctgtcgtcaaggtgggctgtgtcccagcccctccagctcagccttttcatctgttcaggctggtgctcacgagtgcacaggacgcctttcagaaggaggattctaaatcccgggggtctgtaatggcacagccacatgtctgagcccaaaacaagagaaccacatgtgtttttgccacacttcttgccagtgctgtccatatttgtgtacataattttttgtttcttttctttgagacagagtctcactcttgtcacccaggctggagtgcagtggcacgatctcagctcactgcaacctctgcctgctgggttcaagcaattcttctgcctcagcctcccaagtagctgggattacaggcacccaccaccacgcccaggtaatttttatatttttcatagagatggggtttcgccatattggccaggctggtctcaaactcctgacctcaggtgatccacctgcctcagcctccgaaagtgctgggattacaggcgtgagacaccacacccggctcttgtgcacgtaattctattttatttgagatggagtcttgctctgttgcccaggctggagtgcagtggcatgatctcggctcactgcaacctccgcctctcaggctcaagagattcttgtgcctcagccttccaggtagctgggactgtgcaccaccatgctgggctaatgtttgtatttttagtagagttggggtttcacttagccaggctggtctcgaacttctggcctcaaaagatctgcccgcctcggcttctcaaagtgccttggattcccaaagtgctgggattacaggtgtgaaccatcatgcctggcctgtgcacatcatttcaataactgatattttgaaaacattgtttattgacataatttatgtacaataaaatgtattatttacaagtatgtctttcaataagttttggcaaatttatacagttatgtaaccaccatttctggcaaaccagaaagctgccatctgtccctttatagtcatgtaaatagacttttctaaaatgtcatgtaaatagaatgatatatcttaaaaatttttatttctatttttgtaaatt

SEQ ID NO: 425324 - DNA, 1001 bp, Homo sapiens
tcggagaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgagg

SEQ ID NO: 425325 - DNA, 1177 bp, Homo sapiens
agtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctagccacaggagtaggaccaagccagacagagaacacacaaacagaagacaaagaaaccagccgacgaagcaaagaccagagccgaggcaaaagtgaacaaggagagaagatgcttcagctccaagatacaggcgaagaagacgaagatcaagttgcattgcaccgcccacgcccaagcgccaaactcaagcgcgtcagcatccttccaaaaagtcgaagaagcatgataaaagcgaaaccggaaaagaattggcatgaaaaaccccgaaatttgcaccagaacggcgacccctcccaaacaaaatcggagaaagagcgaccgaataaccctcgtgagaacccggacggattgaggggagagaccgagcgagtgtagaaacccgactgagggaatatggcacaagggtggacaaaaacgagaccgattggatccgggccctccgactttgaagttaccatgaataagtctggaaattttttcggggctggagggaggggacaaaaattgggatctaagtgggggcctttcccccaaataattccgtgaaattaatatcggaaaatagaggctcatacatagcagcttatgcattcctcacttgggccaagatcataataggtttaaaaataatggcattgggaatcggttttatgtaaaacacctcctatgaggaaagattgaaaacaacaccactctgcggaatttctctcccaaacaaatggaaagtggttatagatatctcgctagaacaagaaatttcccaaataagttcgccaagtttcgcctccatcgcgcccctagaagactctgagtagactgaaaacatctccgtgaatggtcctaaatatattggctattgtcggtcgagatactcttataagtgggcgttgacagagtaagtagattgcgcagcggagcccaattcagtctgctcgggagaaagtgcattgagtaaccgac

SEQ ID NO: 425326 - DNA, 847 bp, Homo sapiens
tcggagaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgagg

SEQ ID NO: 425327 - DNA, 664 bp, Homo sapiens
ggcagtatttccaggaggctgtgagggggaggtccaacgcagtccagctgacaaggatggaatacgccatgaagtcccttagccttctctaccccaagtccctctccaggtgaggaaagtcatgggcagaatggaaagagagccacctatgagctgtaagccagaacttctcaaactttaatgggtatacaggtcacaggggaccttgttcaagtgcagattctgattcaggaggtctggagtgggacccgagattttgcactgccaagaagtccctgggtgatattaatgctgctgcttacaccaccaccacaccatgcataaaaaggagtagacactatgcttggtgcttttactcctgatctcatgtaagcctcacaacaactttgggaagtgggggttattataccaaattaataggtgagagaactgaggcacatagtgggtgctctcaatcacccagcaaatccatgagggagccaagattctaaattgggactgcctgactgtaaaatccaggtcctttcctttcctttggttctaaattgagtgcttcagttaaaaaaataccttacattgacttcaggcttcccccacttcatccaactttacaggtgaggagagtgaggccaagacaggtggtaaatggggaatgtggggtggg

SEQ ID NO: 425328 - DNA, 1129 bp, Homo sapiens
agtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagacatgatccgccactacgtgtccatcctgctggagagcgacaagaagctcacccaggaacaagtatctgacaggggacgaggcacccacagtccctctcccataagcctgccaagaagattgatgtggcccgtgtaacctttgacctgtacaagctgaacccacaggacttcattggctgcctgaacatgaaggcgactttttatgatacgtactccctttcctatgatctgcactgctgtggggccaaacgcatcatgaagtgagcaaattggggtttcctggggacaagggaagctctccactgggcccttttcagcatgcaagccacgggccacgtgctgcttcacctcctgttacctgcagcagctcctcgatgccacagaggacgggcatccccccaagggcaaggcctcatccctcatcccgacctgtctgaagatactgcagtgaaagcccaagccctagctttccccagtgaaggactagactaggggccccacgctcaactggtagtggccacaagcctggcagctgtagagccgctaacctcccgacacctccctcaccacacaggaccctgagtgaggaggaggggctggaaacctggggtgggttggccaaaggagaacctcaggctcctggcctggcccagctccttcctgcccaaggtagcttagcccatccagactggtcctgaagtctgtccctccattggcatgaagtctgcccctcagcagtccggcctcacaggctgtactttcatggtgctctctaccttctggcccccatcccagaacattcgtgagtgaattcgcaagcatactagcatgtgatattagggagtttgcaataaattattgatgctgatgta

SEQ ID NO: 425329 - DNA, 980 bp, Homo sapiens
agtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagacatgatccgccactacgtgtccatcctgctggagagcgacaagaagctcacccaggaacaagtatctgacaggggacgaggcacccacagtccctctcccataagcctgccaagaagattgatgtggcccgtgtaacctttgacctgtacaagctgaacccacaggacttcattggctgcctgaacatgaaggcgactttttatgatacgtactccctttcctatgatctgcactgctgtggggccaaacgcatcatgaaggaagctctccactgggcccttttcagcatgcaagccacgggccacgtgctgcttcacctcctgttacctgcagcagctcctcgatgccacagaggacgggcatccccccaagggcaaggcctcatccctcatcccgacctgtctgaagatactgcagtgaaagcccaagccctagctttccccagtgaaggactagactaggggccccacgctcaactggtagtggccacaagcctggcccagctccttcctgcccaaggtagcttagcccatccagactggtcctgaagtctgtccctccattggcatgaagtctgcccctcagcagtccggcctcacaggctgtactttcatggtgctctctaccttctggcccccatcccagaacattcgtgagtgaattcgcaagcatactagcatgtgatattagggagtttgcaataaattattgatgctgatgta

SEQ ID NO: 425330 - DNA, 917 bp, Homo sapiens
cagtgtgaccagagccaggggatgagaaacatggagtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgagg

SEQ ID NO: 425331 - DNA, 607 bp, Homo sapiens
tttagggggagaagttaaggtataaactttgtcaatgaagtcctattaaaaacaacaaaaaagtgaagcttaggatgcattttataaactctgaccagaacacctgtgtttctctgtttctaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaaggtctactcttacaattaactttgcagtaatactagttacactctattgattatgggcctgccctgtgctaagcagtctgcattccatcttccttgccaaaacttataatacaaatttcatctttattttataaataggggagttgggctgggtgtggtggctcacgcctgtaatttcagcactttggaaggatcgcttcagcccaggagtttgagacaacctggccaagtgagaccctgtctctacaaaagaaaaaaaaaaaa

SEQ ID NO: 425332 - DNA, 279 bp, Homo sapiens
ggtggtgatctagaggatcctcagaggacaaggaggaggaagtgatccaaacacacagaatcctaagtatatcactgcagcctgtgagatggtggcagaaatggtggagtctctgcagtcggtgttggccttgggtcataaaaggaatagcggcaggaatggtctaggagggcgtagtgctggctgcggaagagggcctcaaagggatacggctgtggctactccggcatccacctcaagaccggcctctgactgtcattcccctcatccagtctctcc

SEQ ID NO: 425333 - DNA, 13177 bp, Homo sapiens
ctgtgtcttcaaactcttctgttatagctggaaaatcctttttaagtgaaatctgcccaaattataagacagatgaaggtagagttgtgttggatataggattagggtgaaagtagtgggggtgtcctggagcctctcttctggtggcagcctagctcttgtgcctttgaggaaattaccctggggacggctctgtggaacatatttgcaaaccactgatttggaagatagagatggcttttgttaagatctgaattcacctttttggcattttatttgatttctcaaggtaaagaacttattttgtaataaagtttcctattatttagtagataggccaagttgctgtgttaattccatgtagattttgggtttcctttgctcattttttcactcttaatctcacatcattgtaagtttatggaagttatcatacttctgactttttctttgaagagcagaaattagaaattcccaataattattttgatagtgtcatttaatgacactcacatgtgatgtagccacaaagatttaatgagttcagttttaaatcatattaagactgttggtttcatttgttctcattaatgtaattctgaagatgaacaataaaatgtatttttagaactttcaaatgaaatattatttcatccttccagatcatataatgcttaagttctgattgttaatcataaagtctagaaaattaaaagataataaaatgaaagtgacttttaggtattagagttttattataaattctggtgtgtcattggagctatgacatgaatatttcaaaggccaatagcattggatctttacagttataacttaccatttttaagtttaagtagtaatatagattatttaataatcaaaatcaataaatattaattattaaaatgttttgtggtatagtttgagaatcattgcttttaactttttccatataggtttattgactttaatagcattctaaacataacatctctacattctttgtgtttaatactgtggaggtataaaaatacttatatatgatgataaactatattagagtaaattaaatattcttatgagtttcattttagagtgcatttacttaattttgaagtccttatttttagcaaactaaaaggaatgttggtacattatttactaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgtggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 425334 - DNA, 11024 bp, Homo sapiens
tgtatttactgagataaagtattcttaatcaatgttcttgagaggtgtgggaaaaatgcaacatcctggttgcagttaaacccagaacattgtgtgttgaagagtgacggttctcaaaccgtcaagacgcgggtactgagtgggactaacctgctgtcctcttgccttggaccttgtgttccagaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgtggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 425335 - DNA, 12730 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 425336 - DNA, 11576 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcagcagcagcagga

SEQ ID NO: 425337 - DNA, 4903 bp, Homo sapiens
ctgcacacggggagtgggcttcccttctcttttccttgcaggatcataccagtgggccagttttgacttggtcgggaggaggcatgaacacctgagactgtgcagcgattctttgacacagaggcctttctccctgtgcagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgtggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 425338 - DNA, 8648 bp, Homo sapiens
  misc_feature (8627)..(8627): n is a, c, g, or t
  misc_feature (8632)..(8632): n is a, c, g, or t
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggcaaggcctggcggacctggaaccgctgtggaaacacctangacancactgccacaggttga

SEQ ID NO: 425339 - DNA, 5274 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtaagaggaatgtatgttggaactgtcgtggatactttattgacccgtgcagatggaaggaagtgccatgtggtaacgctcactgttaactgtgttactttgaaccaggtttgggctttctggggcctgggtagattgcggtgtttgcaaaacaccagcaatctgggtgaagctttatcttcttcaaagcctttcctaatcatg

SEQ ID NO: 425340 - DNA, 2273 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggtgattatttcagaaatcagagtcttgtgttgaatcttactgattttcttgtatttctgtaatgtaatgtatcttgtatttcttgtaatactgtattggactctgtgtatatctcttctcagatgagtgattatatgtgtgaatgttgctggaatctgataaccaggcctgaatagttttgtagggtggcttttaaaaattactttcatatcagaattgctttgtcataaattttgaacgcatcataaatttctaatgttcggggtcagcagactttttttgtaaagggacagagtgtaaacatcttagctttatgggccatatggtctcttttgcaacattcagctctgccctgtgacaggaatgcagttgtaaagacatgagctactggccagctatgttccagtagaactttacttacagaaacagacaggctgtagtttgccaatacctgccttagggaatgtgttgttatattttgtgagttaccttctcagtaaattttatttagtattagtcaggaatattattaagtagcttcttttccagcctggtcaacatagtgagacccggtctctaccaaaacaaaacaaaacaaaaaaacagccacgcatgtggcatgtgcctgtag

SEQ ID NO: 425341 - DNA, 1873 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaaggtctactcttacaattaactttgcagtaatactagttacactctattgattatgggcctgccctgtgctaagcagtctgcattccatcttccttgccaaaacttataatacaaatttcatctttattttataaataggggagttgggctgggtgtggtggctcacgcctgtaatttcagcactttggaaggatcgcttcagcccaggagtttgagacaacctggccaagtgagaccctgtctctacaaaagaaaaaaaaaaaa

SEQ ID NO: 425342 - DNA, 1093 bp, Homo sapiens
caaattggggctgaatttgagttgacagtggaccttctttatgtctactgctcatatttgaattgcaaatactgcctcttctctttcagaggctcattaccctatagctgtattattgcaaagtgcacaattacagcttgagtgtaagtcacactgcgctggcaggacggcccactgagaaagggcacgtttcctgttcgttagttttcacattgacacataatttacaatacagtaaaatgtacttttctatcaactgtagtcagtaacagcccccctcccccaaccacatcaagatatagaggagtgctgtcacttcaaacagttccctcttcctctgccacatcctgcccctccccaggtctaaccaccaatccgtgctctgtccctctgttcagcccattgcagaaggccatagaaatagaatctataggctaggtgtggtggctcatgcctgtaatcccagtattttgagaggctgaagtgggaggatgacttgaggctgggagttcaagactagcctgggctgcctagcaagaccccatctccaggcaggaggatcacttgagctcaggagttagaggttacagtgagctatgatcgtgccactgtgctccagcctaggtgacacagcaagacgttgtctctggggaaaaaagaaagaaacggaaccacgcggtgtgcagccttctgagtctggcccctttcggtgagcagtgtctaaagttctgtcgcgtgttgcccacgcgtcggtggctcgctccttgcaactgctgagcattgtatggctaggctgtagtttgttttcacttcaccagttgggaaacagagaaaaggcactttttaaaaagtttaaatctgtagaattttggtttttaccagttctcttctaaatcctgagggattacaggaaaagttgttgtatttcagaatattcttagcttgatgtgacctctgtccccgttaaggccctttgccgcaatgggaaggacgtcgctcggtcagaccctgaaggtcagaggggcagtttgggagtgtgtcaacattttaactgtatggactagagccaagagtctcaaggtttataattccc

SEQ ID NO: 425343 - DNA, 354 bp, Homo sapiens
caatggcctttttctttttaacagaaatttgaaatttcttatcagtcatttgatttgtttgaggtgcttcttgaaatgagcctctcatctcatgtacttggaaaatacccatctcgcatattccacaggaaacaccgggctggagttgacatccactcctgttcgcagtttttgcttgagttgtacagccgctggatcctgccgtccagctcagccaggaggaccccggccatcctgatcagtgaggtggtcagatccgtaagtgagccttcccattcccctcacacctgcacgtgccacacgcaccacacacgccacacaccccacacacacacaccgcccacacacatgcca

SEQ ID NO: 425344 - DNA, 214 bp, Homo sapiens
gggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggtaagaggcagctcgggagctcagtgttgctgtggggagggggcatggggctgacactgaagagggta

SEQ ID NO: 425345 - DNA, 631 bp, Homo sapiens
agctccccaaggacagtgatgaggcactcgtaagtgcttgctgcctagatgggtccctctccacctttgctagattctgagcattcactgagttagagctgcttctgcaaatgtgctgcttctgctaagtggctgtgacttcatgcagccttcacttggtttgtcatcagtggagatgccctgtgttgtcgaaggagataagcccagtaagcctgctgggcaccttttggtttgcaggttcagcaggcagcccatggctttccctgtgtcgcattgaagcagctggctaaaattgatgatacattaaattcctgtgacagatgatcagcttgtatttgtgtaatggtgtacagttcacaaagcttaaaaaaatgctacctgccatttcatcctcagtgaggaaggtgatacacagagagaccaagtgactgtgtccacggcgacggcgctctgcatttcactttagcggttaatgtactctacctatatttttactttatatttaccatatatcttttcatgtatacttggcgtaagtgctttatagtagtcacctaattcactgtcatcttttttgtttcttggaaggtttctattacaactggttggtattcttttagaagacattgtt

SEQ ID NO: 425346 - DNA, 419 bp, Homo sapiens
aaaatcaataaatattaattattaaaatgttttgtggtatagtttgagaatcattgcttttaactttttccatataggtttattgactttaatagcattctaaacataacatctctacattctttgtgtttaatactgtggaggtataaaaatacttatatatgatgataaactatattagagtaaattaaatattcttatgagtttcattttagagtgcatttacttaattttgaagtccttatttttagcaaactaaaaggaatgttggtacattatttactaggcaaagtgctcttaggagaagaagaagccttggaggatgactctgaatcgagatcggatgtcagcagctctgccttaacaggtagttctcactagttagccgctggtgtggaccttcactgtctgccttccac

SEQ ID NO: 425347 - DNA, 237 bp, Homo sapiens
acgctgtcacgtgcttgaagaacgccacctgagaaagggggcgagaagtggtgtccgctggtaaccagaggtgttggcttagccatctgcagggaggagggtggtctatcacaggtgagtttcatctactttcttaagcaaattaaccttacttttgtgttaggcttgtcccaaagctgttttataaatgtgaccaaggacaagctgatccagtagtggccgtggcaagagatcaaa

SEQ ID NO: 425348 - DNA, 820 bp, Homo sapiens
ggggatgtgcacagttgaaggaaataactaggtttcagaggtcagcttggtggcctgtttttgccttgcgtgcagcagaggaagtagaatctgaggatgagtttggttttcactagccgaggggagggaggaaatgatgggagcaggtaggttattgggtctggttttgttcatttgaaaacaatctgttgtttgaggctgaaggtggcttgggtgatttcttggcagtgctggttccggacagggatgtgagggtcagcgtgaaggccctggccctcagctgtgtgggagcagctgtggccctccacccggaatctttcttcagcaaactctataaagttcctcttgacaccacggaataccctggtatgttaaaagttcacatcttattttctcagatttaatcattattgtaaaaactatttcagtattgactattttagttttagagcagtaagtgttttgagttcatttgggatatttgacctgcgttgtagctcttcagaaaacacatgaatagtgaagttctttgtttcatgggttccctttagatgaaacccatagaggagaaaagtagaaacctcagcacgtaagagccaacatatatacacatcggatttaaacctaaagcacaaattgtgcctggtcgcagtggcgctgagtcgcactcagccaggccaggcattcacactcagggtgagtgggaaccaggactggctgaggcagcagtggacccaagtctccatcgcgcccatgcttactatggagccttctcgttctctctttttctttgggtgagagggtacacttgtgtttttga

SEQ ID NO: 425349 - DNA, 464 bp, Homo sapiens
tcagattttcttaatttctatgtaatgtcctttttctgttccagaattccatgcaggacaccggatacctcattacatttcattgtcatgtcaccttaggctcctcttgacagtttctcttctttttttgcttagaaattctccagaatttcagaaacttctgggcatcgctatggaactttttctgctgtgcagtgatgacgcagagtcagatgtcaggatggtggctgacgaatgcctcaacaaagttatcaaagtaagaaccgtgtggatgatgttctcctcagagctatcattgttgtaggctgagagaagaagcgatcattgagtgttcttctgttttgagtccctgaggatgtctgcacttttttcctttctgatgtatggtttggaggtgctctgttgtatggtttggaggtgctctgttgtatggtttggaggtgctctattgtatggtttggagg

SEQ ID NO: 425350 - DNA, 13654 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgtggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 425351 - DNA, 13807 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgtggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcaaaaaaaaaaggggggctaaaaatcccgagggcaagtacacggacccgttttgaaagggccaagagggaaaaaagggggggttaaaacgaggaaacggtggctgggaccctctggcatggaccaaaccggaaaagttggctctggttaagcaga

SEQ ID NO: 425352 - DNA, 8466 bp, Homo sapiens
caaattggggctgaatttgagttgacagtggaccttctttatgtctactgctcatatttgaattgcaaatactgcctcttctctttcagaggctcattaccctatagctgtattattgcaaagtgcacaattacagcttgagtgtaagtcacactgcgctggcaggacggcccactgagaaagggcacgtttcctgttcgttagttttcacattgacacataatttacaatacagtaaaatgtacttttctatcaactgtagtcagtaacagcccccctcccccaaccacatcaagatatagaggagtgctgtcacttcaaacagttccctcttcctctgccacatcctgcccctccccaggtctaaccaccaatccgtgctctgtccctctgttcagcccattgcagaaggccatagaaatagaatctataggctaggtgtggtggctcatgcctgtaatcccagtattttgagaggctgaagtgggaggatgacttgaggctgggagttcaagactagcctgggctgcctagcaagaccccatctccaggcaggaggatcacttgagctcaggagttagaggttacagtgagctatgatcgtgccactgtgctccagcctaggtgacacagcaagacgttgtctctggggaaaaaagaaagaaacggaaccacgcggtgtgcagccttctgagtctggcccctttcgaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgtggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 425353 - DNA, 5725 bp, Homo sapiens
ttttttctaaaatgtaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgtggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 425354 - DNA, 9135 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagttatatgccactccagctggcacacaactcagatgccgcacacagcacacgacactcacagaccctccacacagcacacaactcaggtgccgcacacagcacatgacactcacacagacgctccacacggcacacaactcagacgccacacacagcacacaacactcatacacagcacacagcacatgactcacacagatgccactccag

SEQ ID NO: 425355 - DNA, 4588 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcggggtaacagttgtggcaagaatgctgtcgttggtggaagcacgaaagagcaagcaggaaatactttgtaaaagaataaaaacgaaaaatgttagcgaaaaaat

SEQ ID NO: 425356 - DNA, 3084 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgagggtgagcataatcttctgtggaaccatttcttcacttagtggacattttatcattgctacaattaaaattggagcttaataggaaatatttccatgcactctaaagctgtaaccagtaatacccaccatgtatccatctctcagctttagaaagaaaacgttgccagtaaagttaatgcttcataaacttcagtttaagttctaattctcagaatatttgtttgaaatagacctcttcctaaaggatatatttagaaataacctatcatta

SEQ ID NO: 425357 - DNA, 431 bp, Homo sapiens
gtacgtcttcatcctgccgactattgccagttgcagttttccctgccttaaaaatggagtattgaaatttttaactttaatttctgatttgcaaaatagtcatcttttgttcttttccttcttgctgttagccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacaggtattgggaagagaaaccctgatattgatttatattgaaaatttagcaggccaagcaaaacaggtggctggctttttcctccgtaagtatggtcttgacatggtcaccgatagaaacatggaa

SEQ ID NO: 425358 - DNA, 2951 bp, Homo sapiens
atctaagaaatcactgccaaatccaatgttgttaaaagtttcccttatgtttctcctaaatgttttagttttagctcttagtttaggcctttgatctattttaatttttatatatggtgtgaggtagatctagcttcatgtggatgtccacttgtctagcaccatttgttgaaaagactgtcctttctcccttgaatggtcttggcaccatcaaaaatcatttgacccatatgtgcaagggtttatttggggatttgctattctgttccattggtctacatgactgtctttgtttcaatacaacaccattttgattattgtagctttgtcgtaagttatgaaataaggaagtgagagacctcctacttggttccctttcaagatgattttggctgtgtgaggtctcttgagattccatatgagtttcaggatggaaaaaaaaaagccactgggatattctgatagagattgcatgaaatctatagattgctttggactatggacatcttaaggtatccaatccataaacacgggattgctttctatttatttgtgttgaccttactttctttaagcagtgttttatggttttcaagtacaagtcttttgcttccttaagtttattcctaaatatttcagtttttttgttactattataatggaattttcttaaatttccttttgagattgcttgttattgtatagaaatatcatggatttgttgtgttgattttgtaaactgcagtgttactgaaatttttttttgtatatgtatggacactaggattttctacatataagatcatgtcatctgcaaacagataattttgcttcttcctttccagtctggatgccttttatttctttttcttgcctaactgctctaagactccagtactgtgttaaacagaagtggtgagacagggtatttctgtgttgttcttgatcttaaagtcctttcagtcttattgaatatgatgtttacagtgggatgttcatatggcctctattttaggttgtttccttctattcccaattgttgagtttttatcatgaaagggcatgacattgtctcaaatgctttttctccatcaatggagatcacatttttttccttcattctattaatgtaatagacattacatttattgacttgagcatgttgaaacatctttgcataccagctgtaaatcttacttggccatgatgtgtaatcctttcaatgtcccactgaatcctgttggccagtattttgttgaatattgatttaaaaaaatcttgatcaggaatactgatgtgtggtgtttttttcttatagtgtctttgtctggttttggtatcagaataatgatggcctcatagaatgcatttggaagtgtcctttcctcttcagttttttggaagagtttgaggagaattgatttaattcttcagatgtttgccagaattcccatatgaccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcggttgtaatgtctcctcctggtttttagttgtttttcttagtcactcttagctatcaacaaactcttggtttcatttatttttctctattgcttttctgttctctattttgtctctgctctaatctttattattattataatcatctccattctgctggctttgggttgattgctcttctttttctagttctttcagatgtaaattttgggttgacttgagatcttaatttgtttaataggtgtatttacagttacaaatttccctcctaccactgctttgactgtacctgtttttttgtatattacgtttaagttttcatttaccacaagatattttctaatttcccttgtgagttccccattaatctgctggttgagagcgttgtttaattttcacataattgtgtacttttcagttttttgtctgttactgatttctagtttcatcccactgtggccagaaaagatattttatttcctcagtcttttgaaatttgttgacttgtttagtcatctaacatactgtctatcctagagaaaggtccatttgcacttgagaaaaacgtgtgtactgctgttgtgtctgttaggtccagctggtatgatgctgttcaagttctgtcttgcgactgatcttctgtctggttgtcctatccgttactgaaagtgggctactgcagtctcctactcttactgtagaactatccatttcttcctttgattctgtcaatgtttgtttcatatattttgggctctgatgtttggtgcatatatattacatcttggtgaattttcaaactttttaaatttcaacatgaagatgaaattataggatgtctgggatttcctttgaatccgtggggctgggagtaactataaatgaaacaagattggccgggaatttgaggctgcaaggataggtacacacaggggagtgaagcagggcttggagcagatggtaaagattgttggcttttccagccatggggctctcttgccacttggcagtagtggcatgaagccgccaccagggggccacgcaccagtgcatgtggctgtgttccaaactttttggacaataaaatctgaatttcacatacttttcttatgtcattagatattacccttttacatcttttcactatttaaaaatgtaaaaatcattcttaacatttgggctgtgcaaaaacagctggtgggcccaattttggcctgtatttcacttgccaacccgatttatacttttgtatctatttgacattttccattaaaagttatataacacta

SEQ ID NO: 425359 - DNA, 2897 bp, Homo sapiens
atctaagaaatcactgccaaatccaatgttgttaaaagtttcccttatgtttctcctaaatgttttagttttagctcttagtttaggcctttgatctattttaatttttatatatggtgtgaggtagatctagcttcatgtggatgtccacttgtctagcaccatttgttgaaaagactgtcctttctcccttgaatggtcttggcaccatcaaaaatcatttgacccatatgtgcaagggtttatttggggatttgctattctgttccattggtctacatgactgtctttgtttcaatacaacaccattttgattattgtagctttgtcgtaagttatgaaataaggaagtgagagacctcctacttggttccctttcaagatgattttggctgtgtgaggtctcttgagattccatatgagtttcaggatggaaaaaaaaaagccactgggatattctgatagagattgcatgaaatctatagattgctttggactatggacatcttaaggtatccaatccataaacacgggattgctttctatttatttgtgttgaccttactttctttaagcagtgttttatggttttcaagtacaagtcttttgcttccttaagtttattcctaaatatttcagtttttttgttactattataatggaattttcttaaatttccttttgagattgcttgttattgtatagaaatatcatggatttgttgtgttgattttgtaaactgcagtgttactgaaatttttttttgtatatgtatggacactaggattttctacatataagatcatgtcatctgcaaacagataattttgcttcttcctttccagtctggatgccttttatttctttttcttgcctaactgctctaagactccagtactgtgttaaacagaagtggtgagacagggtatttctgtgttgttcttgatcttaaagtcctttcagtcttattgaatatgatgtttacagtgggatgttcatatggcctctattttaggttgtttccttctattcccaattgttgagtttttatcatgaaagggcatgacattgtctcaaatgctttttctccatcaatggagatcacatttttttccttcattctattaatgtaatagacattacatttattgacttgagcatgttgaaacatctttgcataccagctgtaaatcttacttggccatgatgtgtaatcctttcaatgtcccactgaatcctgttggccagtattttgttgaatattgatttaaaaaaatcttgatcaggaatactgatgtgtggtgtttttttcttatagtgtctttgtctggttttggtatcagaataatgatggcctcatagaatgcatttggaagtgtcctttcctcttcagttttttggaagagtttgaggagaattgatttaattcttcagatgtttgccagaattcccatatgaccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcggttgtaatgtctcctcctggtttttagttgtttttcttagtcactcttagctatcaacaaactcttggtttcatttatttttctctattgcttttctgttctctattttgtctctgctctaatctttattattattataatcatctccattctgctggctttgggttgattgctcttctttttctagttctttcagatgtaaattttgggttgacttgagatcttaatttgtttaataggtgtatttacagttacaaatttccctcctaccactgctttgactgtacctgtttttttgtatattacgtttaagttttcatttaccacaagatattttctaatttcccttgtgagttccccattaatctgctggttgagagcgttgtttaattttcacataattgtgtacttttcagttttttgtctgttactgatttctagtttcatcccactgtggccagaaaagatattttatttcctcagtcttttgaaatttgttgacttgtttagtcatctaacatactgtctatcctagagaaaggtccatttgcacttgagaaaattctgtcttgcgactgatcttctgtctggttgtcctatccgttactgaaagtgggctactgcagtctcctactcttactgtagaactatccatttcttcctttgattctgtcaatgtttgtttcatatattttgggctctgatgtttggtgcatatatattacatcttggtgaattttcaaactttttaaatttcaacatgaagatgaaattataggatgtctgggatttcctttgaatccgtggggctgggagtaactataaatgaaacaagattggccgggaatttgaggctgcaaggataggtacacacaggggagtgaagcagggcttggagcagatggtaaagattgttggcttttccagccatggggctctcttgccacttggcagtagtggcatgaagccgccaccagggggccacgcaccagtgcatgtggctgtgttccaaactttttggacaataaaatctgaatttcacatacttttcttatgtcattagatattacccttttacatcttttcactatttaaaaatgtaaaaatcattcttaacatttgggctgtgcaaaaacagctggtgggcccaattttggcctgtatttcacttgccaacccgatttatacttttgtatctatttgacattttccattaaaagttatataacacta

SEQ ID NO: 425360 - DNA, 3837 bp, Homo sapiens
atctaagaaatcactgccaaatccaatgttgttaaaagtttcccttatgtttctcctaaatgttttagttttagctcttagtttaggcctttgatctattttaatttttatatatggtgtgaggtagatctagcttcatgtggatgtccacttgtctagcaccatttgttgaaaagactgtcctttctcccttgaatggtcttggcaccatcaaaaatcatttgacccatatgtgcaagggtttatttggggatttgctattctgttccattggtctacatgactgtctttgtttcaatacaacaccattttgattattgtagctttgtcgtaagttatgaaataaggaagtgagagacctcctacttggttccctttcaagatgattttggctgtgtgaggtctcttgagattccatatgagtttcaggatggaaaaaaaaaagccactgggatattctgatagagattgcatgaaatctatagattgctttggactatggacatcttaaggtatccaatccataaacacgggattgctttctatttatttgtgttgaccttactttctttaagcagtgttttatggttttcaagtacaagtcttttgcttccttaagtttattcctaaatatttcagtttttttgttactattataatggaattttcttaaatttccttttgagattgcttgttattgtatagaaatatcatggatttgttgtgttgattttgtaaactgcagtgttactgaaatttttttttgtatatgtatggacactaggattttctacatataagatcatgtcatctgcaaacagataattttgcttcttcctttccagtctggatgccttttatttctttttcttgcctaactgctctaagactccagtactgtgttaaacagaagtggtgagacagggtatttctgtgttgttcttgatcttaaagtcctttcagtcttattgaatatgatgtttacagtgggatgttcatatggcctctattttaggttgtttccttctattcccaattgttgagtttttatcatgaaagggcatgacattgtctcaaatgctttttctccatcaatggagatcacatttttttccttcattctattaatgtaatagacattacatttattgacttgagcatgttgaaacatctttgcataccagctgtaaatcttacttggccatgatgtgtaatcctttcaatgtcccactgaatcctgttggccagtattttgttgaatattgatttaaaaaaatcttgatcaggaatactgatgtgtggtgtttttttcttatagtgtctttgtctggttttggtatcagaataatgatggcctcatagaatgcatttggaagtgtcctttcctcttcagttttttggaagagtttgaggagaattgatttaattcttcagatgtttgccagaattcccatatgaccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcggttgtaatgtctcctcctggtttttagttgtttttcttagtcactcttagctatcaacaaactcttggtttcatttatttttctctattgcttttctgttctctattttgtctctgctctaatctttattattattataatcatctccattctgctggctttgggttgattgctcttctttttctagttctttcagatgtaaattttgggttgacttgagatcttaatttgtttaataggtgtatttacagttacaaatttccctcctaccactgctttgactgtacctgtttttttgtatattacgtttaagttttcatttaccacaagatattttctaatttcccttgtgagttccccattaatctgctggttgagagcgttgtttaattttcacataattgtgtacttttcagttttttgtctgttactgatttctagtttcatcccactgtggccagaaaagatattttatttcctcagtcttttgaaatttgttgacttgtttagtcatctaacatactgtctatcctagagaaaggtccatttgcacttgagaaaaacgtgtgtactgctgttgtgtctgttaggtccagctggtatgatgctgttcaagttctgtcttgcgactgatcttctgtctggttgtcctatccgttactgaaagtgggctactgcagtctcctactcttactgtagaactatccatttcttcctttgattctgtcaatgtttgtttcatatattttgggctctgatgtttggtgcatatatattacatcttggtgaattttcaaactttttaaatttcaacatgaagatgaaattataggatgtctgggatttcctttgaatccgtggggctgggagtaactataaatgaaacaagattggccgggaatttgaggctgcaaggataggtacacacaggggagtgaagcagggcttggagcagatggtaaagattgttggcttttccagccatggggctctcttgccacttggcagtagtggcatgaagccgccaccagggggccacgcaccagtgcatgtggctgtgttccaaactttttggacaataaaatctgaatttcacatacttttcttatgtcattagatattacccttttacatcttttcactatttaaaaatgtaaaaatcattcttaacatttgggctgtgcaaaaacagctggtgggcccaattttggcctgtatttcacttgccaacccgatttatacttttgtatctatttgacattttccattaaaagttatataacactacttttttgtactcgttacttttttaaaaaaaactttctacaatgaaaatacattatttttacaataaaaagccaaaatacatacacaaaaatgttacccattaattatgggaattacttcaaggtaattcttattttgaaatatctttccaatattttctcttatatcgctttttgaagacgcataacatgatcccaaataaacagttgaataaacaccaccctcctctcccctcctgcccagaaacccacccatctggagctgcatctcccaggaaaggagactctagagggaaccgccttcttgcatttctctagcctggattcccatgggaaagatgtgtatcttcatgctgagctttgaagattcttacagaataaaaattcttaccatatccttctgtcttaatagcacgttttaaagtctctagggagaagagatttctgtaaacactagtttccaaagaataaaaaaaaaaatcacttctcaaaactcaaatggtatttcccatcacccccacaccatccagatttgttcagctttcttgaaaataaattatctaaatttttaaaaatattttcctaaaactctaaacagaagtaacgtcaaagggatcaatagcctcacttcttatgaaagctaaaactctacccctttatcaaaagctaaaactctacccctttatcagtaagtaagtgaaaatatctttgcaactctgaaaaaccatgctgggacattaatttctaaatacttaaatggcggccaggtgcagtccctcacacctgtaatcccagcacttggggaggtcgaggccagagattgcttgagcgagcccaggagttcaagaccagcctaggcaatatagcaagacctcgtcgctacaaaa

SEQ ID NO: 425361 - DNA, 775 bp, Homo sapiens
agactttaaaaatgaaagtcacatattctacaaaaaacattcacattcataaaaatacccttaaacaaaatacaaatttatttttttctttccagtagagggggcagtgattacctggcattgttgcaaaacaaaagttaagcttgccattattgtagttacaatttttaatataatttttgcagttatctctcagtaactttttattatatactatttaattatgaatgtcagggtctgaaaaatacatggtcaattcaggattggttgtaacttttaaaaaaagatacttacattgacttgttgttatctaaaatgtctttattatgtagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425362 - DNA, 1330 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425363 - DNA, 1638 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactagaaaaaaaaggaaactgaatgaaagaaacacatgagggggcggaggagctgaagaagtgatgccccaggagggggcacaaggagtaatgcgggataccacggattctccgggtaccagagggggggcccccagaaagggagaagacgccatgataatagacagaaaggaaccgggggcgggctgctattaaagagcgctgagggggcggggcaaaaaagtgtgtgaactctggggactcctgaggtgaagcagacaccatgaacatcgaggggggatgaacaccagaatgggggcacaaacacgccaaga

SEQ ID NO: 425364 - DNA, 1330 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctgacacacccccccaaccccatcctgaggcagtgcctggcagataacttaggttggccgcagaagctattcatacccgacagcatgtgtgtaagtgcttatggtgggcatggtggacctcatctgtgcttcttcctccctctggtttaaagagatatattaactaatttcgcatcatttgtgtgtgcaggtgactggtttttacataagtcctacttatacctttgatatgttccagtaattaaagttattttatat

SEQ ID NO: 425365 - DNA, 3045 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggtatcaggctttgtaatctgctgggttttgtttgtgtagtttgtttttaccttaactgtagatttaccttattgtgtgtgtgtgtattattgctgttggatatctgaacattatgaatacatttacatctgtgttcttactctctgtataccacttccctagagagggaaccatgtgctggatttagccagtcctgtagttttccatacctgaaatcaaaacgggccatgcttcacatctacccacgatgaataggggtcctttcatttagagtaagcggagctgactgaattctgagcaaataagtattttgtgagaaacattatttttcattttaaaaataagtgtctaatactgtgtattcatatagcctttatatcccaatacgtgcttatctgttggtataccttagagaaataacccaccatcaatgagaagaaggaaaggcaggaggaaaaaagtttatataacactttaaaatggtagattatttgtggccatttgaatttactgatttgaagttcttaaagatgctgagccatgccttacatagttattttagaatctaaagttgttctgtatttgcataacgtttctgttctttttcttctttaaaccctgaaagtgatagatgggaaggaggaaccagatatttggcatggtctgacaaaaattaacttgtctttgtagcaggatatgctcacaactggagtgttttcaatgcattgtatattccatggatttgttttaagtaaaatcagaaacttgagttaactctttctgggtgttaaattaatgatttatacaggaaagttggaaaaggtggtcagcagttaacaccggaagttcaagaggttatggtgactttggaagattatttgaattactaatttaaagtgatttagcatctgttacatattattgaataaaggagaaggtgtacttggagttttacttaagaatatttaactgaatcagttaatcctcgagaatatttaactgaatcattcatcttggacatgattctgtgcaactacattaggatggtatattataatttgatttttaatattagatttgatatttaatatttaaaaaattagaagcaagtaggaaagggttttctgtgctttcaatgtgttaaaaagccagccagaggtgagtaaggggaagcaatggtgagacgccaagtttttcaccctgctatgactggggcaggatctgggatatcaaccccagacaacccaggcctggattgattttttctgttggagattgacagttcacactggcctgcctcagaatgttggcactgccactgactaattctgtgactggggcaccttttatagcctccatcaggctgtttccccagctataaaatgctgaaagtgaaacctagcttaaatggctttcttaaggaatagaaaagaaacacgtgtaaactatctggtacatagtaggtgctcagcaaatgtccattccctctctttgtagtacgttcctcttttgaaattcaatactttatcaaggcatttgccctctgctgtgacttgctttaatccaccatcctgtttatcagacgtgcggttgagggagaagaatgcaaggcactgaagagagttatggagcgtaaaagcctttgtttacaaataacttggaacctgttagagggaagattatatgatttgagatcacattatttaacgttcatatggtatttgcatttttccagttatttctatttagtagagagaagtaatttagtttataaaaaaacaagaattcaaaattatttttaaaactaaccctccagtttattattttttatttttcttcgagacggagtctcgctgcttatcgcccagcctggagtgtagtggcacaatgtcggctcactgcaacttctgcttcctgggttcaagggattctcctgccttagcctctcaagtagcagagattacaggcacctgccatcacacctggctaattttttttgtgtgtttttagtagagacggggtttcaccatgttggccaggctggtctcaaactcctgacctcaggtaatctacctgccttggcctcccaaagtgctgggattacaggcgtgagccacctcgcctggccagccatccagtttataaactggattttaatctgccagtaaatgtattcaagtaaatatgtgaattgatgcataaagcagttgattatcaagtgtgtaagaaaat

SEQ ID NO: 425366 - DNA, 2202 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggtatcaggctttgtaatctgctgggttttgtttgtgtagtttgtttttaccttaactgtagatttaccttattgtgtgtgtgtgtattattgctgttggatatctgaacattatgaatacatttacatctgtgttcttactctctgtataccacttccctagagagggaaccatgtgctggatttagccagtcctgtagttttccatacctgaaatcaaaacgggccatgcttcacatctacccacgatgaataggggtcctttcatttagagtaagcggagctgactgaattctgagcaaataagtattttgtgagaaacattatttttcattttaaaaataagtgtctaatactgtgtattcatatagcctttatatcccaatacgtgcttatctgttggtataccttagagaaataacccaccatcaatgagaagaaggaaaggcaggaggaaaaaagtttatataacactttaaaatggtagattatttgtggccatttgaatttactgatttgaagttcttaaagatgctgagccatgccttacatagttattttagaatctaaagttgttctgtatttgcataacgtttctgttctttttcttctttaaaccctgaaagtgatagatgggaaggaggaaccagatatttggcatggtctgacaaaaattaacttgtctttgtagcaggatatgctcacaactggagtgttttcaatgcattgtatattccatggatttgttttaagtaaaatcagaaacttgagttaactctttctgggtgttaaattaatgatttatacaggaaagttggaaaaggtggtcagcagttaacaccggaagttcaagaggttatggtgactttggaagattatttgaattactaatttaaagtgatttagcatctgttacatattattgaataaaggagaaggtgtacttggagttttacttaagaatatttaactgaatcagttaatcctcgagaatatttaactgaatcattcatcttggacatgattctgtgcaactacattaggatggtatattataatttgatttttaatattagatttgatatttaatatttaaaaaattagaagcaagtaggaaagggttttctgtgctttcaatgtgttaaaaagccagccagaggtgagtaaggggaagcaatggtgagacgccaagtttttcaccctgctatgactggggcaggatctgggatatcaaccccagacaaccagccgaatgattaccgggggatgaggtcccgggcgcccaagtggcgccccacaatcgagcggggcgccatacccccacgggggccccaaaggtaggacacaaaggtttcagaccatacccagagaccacaccacccgctgtccg

SEQ ID NO: 425367 - DNA, 1326 bp, Homo sapiens
aaaaccttaccgcgcttagagttagcgagggccctggggggtgggtgtaggtcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425368 - DNA, 1363 bp, Homo sapiens
gtggcagcatgagtctgcatcgcaggttgtgttctggtgtgcagaacatggtcattggctgatgtccttactgaaaatccttcggatcgattgcactaagctgcctttcggcctcctctatccacgtacaacacttgtgctcgcgtcgtggaaagccgcacgcgatactgtacacacagagtctcgcatggatgtctagacagttattcgggagcagtgctatacatcaggtgtcgaagtgaagttccagttggactggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425369 - DNA, 1303 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425370 - DNA, 1171 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425371 - DNA, 1042 bp, Homo sapiens
agagggcggggacgtgtttggcagcgggacgcaccatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccgaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425372 - DNA, 468 bp, Homo sapiens
gttgcattctgtgagacagcgggagacacatcaccttcactttgggatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactaga

SEQ ID NO: 425373 - DNA, 561 bp, Homo sapiens
aaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactagagtttgtatatgttatgttgattattacatttgatttggctggtataaatgttacattgttttcaaaaatatgatggtaactgaaaaatattcttgcatggagaaaaatcatcagtattcataggttcaaaagaatatctgggaattagtaatacatttaagacaacaactcctaacctttttcttttcactcggtgaccatacttctttgaaatacaatacaattactggatgatatcacagtactatgttataagagttgagatgatttatagacagatatatatgtacatacgtttatttgtttacatttatacatatattttacactaaattaactaccctcacctaagtctgggtcactatagagaaattaatcttgtagaaataaagggtttattct

SEQ ID NO: 425374 - DNA, 4109 bp, Homo sapiens
aattgatgagcatgtgttgaatcctcaagagaggagggaggaagcaagaaggaaagcttgaagggaggaggggaggggggcaggtgctgatttcagccctgtagcgtcaggattgcgtcaattcgggttccagccacgtctggagtctcggagacgagcttctcagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgaggaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaagggctgagttgagaacactgtggctgaaatataatttttctcccccctaaggttacatgtgagtcaaaattttgtaaaatataacctcacataagaaccatggccttggattattcactgcctgtcacaagcctcagtgtggcctgagaaatccctatgtacctttgtgaaattgttgaattagttagtgaataaagaaataaacttcaactagaaatccagttagaagtgcaattttcttataggaaataggtatagtgtgcaagtgtacttttaaggccatcgtttgtacccagagtcggcatggccacctaagtcttcatttaatttattgtcccccagaaaagattaagatgctacttgaaaagactgtgaagattttttacattgccagataaaaagtgttacttaaccaacaaacaaatgtaagactacaaaatcgttcaagagcaattctaatataatttacatatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtaatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcattttccaaacaacttatacatgctttttatgactatgcctaatgtaaagaaaatgtattacattctgtatgtacaaagattaaaaatcaacctcttttttgtgctttaaaatgactttgggattaaaaaagcatatttcccaatcattgtcttcattccactacaaagtcacctcacagcatcttgctccactcggcatctctgtgaaagcaacatgaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgattttttttttttaacatggaacaatgaaaccaacaacaaacatttttaaaattaaaatggataatttgtaaatagtttttagcttttaaaatttaaagtgtttttgagtgtgaaaagttgagtaaaactatttgcaactggttttcagaaaagagaaaagaaacaacaaaggaattgaaacaggcagggagatcttaatacctaatttcatcatttctgaaaatgtactgttttagaatgtattacaatatcaatgtgaatatcttgaatcctgttacaaatcctgcactgtattaaacatgtaaattaattgtttgtctgattagccaatctcaccacccaaatggggaggtatacatgtttgaagaactgtgtaactcagtaattgatttgttctgatgttgtaactcaatagaagtgttttggaaggaagcatggtgtgtgagacagtgtctgttcttttgtgccagctctgtatgatgtttgtaagaccatgtttgtaagacatgaataaattgctgcttttgcccaacccgtttca

SEQ ID NO: 425375 - DNA, 4355 bp, Homo sapiens
aattgatgagcatgtgttgaatcctcaagagaggagggaggaagcaagaaggaaagcttgaagggaggaggggaggggggcaggtgctgatttcagccctgtagcgtcaggattgcgtcaattcgggttccagccacgtctggagtctcggagacgagcttctcagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgaggaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaagggctgagttgagaacactgtggctgaaatataatttttctcccccctaaggttacatgtgagtcaaaattttgtaaaatataacctcacataagaaccatggccttggattattcactgcctgtcacaagcctcagtgtggcctgagaaatccctatgtacctttgtgaaattgttgaattagttagtgaataaagaaataaacttcaactagaaatccagttagaagtgcaattttcttataggaaataggtatagtgtgcaagtgtacttttaaggccatcgtttgtacccagagtcggcatggccacctaagtcttcatttaatttattgtcccccagaaaagattaagatgctacttgaaaagactgtgaagattttttacattgccagataaaaagtgttacttaaccaacaaacaaatgtaagactacaaaatcgttcaagagcaattctaatataatttacatatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtaatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcattttccaaacaacttatacatgctttttatgactatgcctaatgtaaagaaaatgtattacattctgtatgtacaaagattaaaaatcaacctcttttttgtgctttaaaatgactttgggattaaaaaagcatatttcccaatcattgtcttcattccactacaaagtcacctcacagcatcttgctccactcggcatctctgtgaaagcaacatgaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgattttttttttttaacatggaacaatgaaaccaacaacaaacatttttaaaattaaaatggataatttgtaaatagtttttagcttttaaaatttaaagtgtttttgagtgtgaaaagttgagtaaaactatttgcaactggttttcagaaaagagaaaagaaacaacaaaggaattgaaacaggcagggagatcttaatacctaatttcatcatttctgaaaatgtactgttttagaatgtattacaatatcaatgtgaatatcttgaatcctgttacaaatcctgcactgtattaaacatgtaaattaattgtttgtctgattagccaatctcaccacccaaatggggaggtatacatgtttgaagaactgtgtaactcagtaattgatttgttctgatgttgtaactcaatagaagtgttttggaaggaagcatggtgtgtgagacagtgtctgttcttttgtgccagctctgtatgatgtttgtaagaccatgtttgtaagacatgaataaattgctgcttttgcccaacccgtttcagaataaaaaaacgtaatgagagagatcaatttaaagcagtaaatgaaacaaacataagaattggtgaagcgaattataggtgctgctaaaagcggtgggactgtagtcagaaagtacaaggagaacgtcaagaagcaaagacacacccagaggagcggaaaaccatgccagcaagtaaaacaccaaaaacaaccgaggggagccagtacaaaggatcaacaggacaccgagggcccgagctgcgtc

SEQ ID NO: 425376 - DNA, 485 bp, Homo sapiens
cggaaattaaaaatttccttgaaagaaacaaaaatacaaacacaacatatcaaaacctaagagggaaatttatagcgttgcatgcctacatcaaaaaagtagatgatttcaaaaaaataaaacaataatgcaccttaaagaactagaaaagcaagaaaaagagccaaactcaaaattagtagaaagaaacttgaaaaatcagagcagaaataaacaacaaacagactagagatcaataaaatgaaaagttggggaggtttttgtttgtttgtttgtttttgtatttttctggggtgagcatcttactctgtcacccaggatgaagtgcagtgcctctgtcatggctcactgcagcctccagctcatgagcgccagagaccttcattcttctgagcagctgggaatacaggcatgtgccaccacacccagctaagattttttttcttcttttttaaaagatgtagtattttttttattgcccagga

SEQ ID NO: 425377 - DNA, 1028 bp, Homo sapiens
  misc_feature (750)..(750): n is a, c, g, or t
  misc_feature (803)..(803): n is a, c, g, or t
  misc_feature (808)..(808): n is a, c, g, or t
  misc_feature (825)..(825): n is a, c, g, or t
  misc_feature (832)..(832): n is a, c, g, or t
  misc_feature (837)..(837): n is a, c, g, or t
  misc_feature (843)..(843): n is a, c, g, or t
  misc_feature (845)..(845): n is a, c, g, or t
  misc_feature (849)..(849): n is a, c, g, or t
  misc_feature (851)..(851): n is a, c, g, or t
  misc_feature (863)..(863): n is a, c, g, or t
  misc_feature (878)..(878): n is a, c, g, or t
aagcatccattaatcttcaggatcaacttgagaagacaggggaaaacaaaggatggagtgatccaacgcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggttcactactgtgatagacaaagtggcaaagagtgtgtgacctgtctgacattagcccctgtgcagatgactttccatgctattggaagctccattgaagccagccatgatcaggtataatatgccactgccattttgctgtgttatggcccagctcggaaatggaaggccatcaaaatggaagctatgtgcgcacatgcagctttgctttccttaatacattatctgctagcaccatctgctagacttgatagacttcttgtttgcagttcattattattttaaatatggaattattttatatgaaaaatagttgtcccacaggttatttttatctttaatagtnatatatgagaggaagggtcaacaaaacaatatagattaacactggagtctcgnctgtnagtatactcattgggtncctgttnaacanaggttngnattnanaaatgttccggngatgcgtcacttaantgacaggatttgtgtgcagaaaaggcgtctccaggggagtgctgcgtggaactctcgatgtttctccaaccaatataaacttccaacctaggtttgtaagccgctcccaaactgtccggttgcggacacacagagcggtgtttccagcga

SEQ ID NO: 425378 - DNA, 1083 bp, Homo sapiens
  misc_feature (676)..(676): n is a, c, g, or t
  misc_feature (805)..(805): n is a, c, g, or t
  misc_feature (858)..(858): n is a, c, g, or t
  misc_feature (863)..(863): n is a, c, g, or t
  misc_feature (880)..(880): n is a, c, g, or t
  misc_feature (887)..(887): n is a, c, g, or t
  misc_feature (892)..(892): n is a, c, g, or t
  misc_feature (898)..(898): n is a, c, g, or t
  misc_feature (900)..(900): n is a, c, g, or t
  misc_feature (904)..(904): n is a, c, g, or t
  misc_feature (906)..(906): n is a, c, g, or t
  misc_feature (918)..(918): n is a, c, g, or t
  misc_feature (933)..(933): n is a, c, g, or t
aagcatccattaatcttcaggatcaacttgagaagacaggggaaaacaaaggatggagtgatccaacgcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggttcactactgtgatagacaaagtggcaaagagtgtgtgacctgtctgacattagcccctgtgcagatgactttccatgctattggaagctccattgaagccagccatgatcaggtataatatgccactgccattttgctgtgttatggcccagctcggaaatggaaggccatcaaaatggaagctatgtgcgcacatgcagctttgctttccttaatacattatctgctagcaccatctgctagacttgaaaaatcaaaattgtttgcgtngggaaattgatatcatagtagatttaaattattttagacttcttgtttgcagttcattattattttaaatatggaattattttatatgaaaaatagttgtcccacaggttatttttatctttaatagtnatatatgagaggaagggtcaacaaaacaatatagattaacactggagtctcgnctgtnagtatactcattgggtncctgttnaacanaggttngnattnanaaatgttccggngatgcgtcacttaantgacaggatttgtgtgcagaaaaggcgtctccaggggagtgctgcgtggaactctcgatgtttctccaaccaatataaacttccaacctaggtttgtaagccgctcccaaactgtccggttgcggacacacagagcggtgtttccagcga

SEQ ID NO: 425379 - DNA, 755 bp, Homo sapiens
aagcatccattaatcttcaggatcaacttgagaagacaggggaaaacaaaggatggagtgatccaacgcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggttcactactgtgatagacaaagtggcaaagagtgtgtgacctgtctgacattagcccctgtgcagatgactttccatgctattggaagctccattgaagccagccatgatcaggtataatatgccactgccattttgctgtgttatggcccagctcggaaatggaaggccatcaaaatggaagctatgtgcgcacatgcagctttgctttccttaatacattatctgctagcaccatctgctagacttgaaaaatcaaaattgtttgcgttgggatttatttaaataatggcattatcttatatgaccaaataagtgtcccacagggtatttttaacctttaatagtaat

SEQ ID NO: 425380 - DNA, 138 bp, Homo sapiens
tcaagcttctaacgatgtacggggacatgaagtttccaataatttttttttctttttttccttcttttttctgtttgtttttagataaaaattttgagaaaaaaaatgaaaaaattctaataaaagaagaaaaatggt

SEQ ID NO: 425381 - DNA, 1426 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425382 - DNA, 1400 bp, Homo sapiens
gctggtaccggcccgaggattgtaaggatcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425383 - DNA, 1410 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtggccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425384 - DNA, 1407 bp, Homo sapiens
cgtgaacacgctgggtcgaccacgcggtgcggagtggtggacctcggactgaaatatgaaggcatgggagccggagagccgagaaccggagatcgacagcggagagagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425385 - DNA, 1485 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtcaggaattgggctgggctggcctggctgtggtgaccctggtcttctcctgtctccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425386 - DNA, 1393 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425387 - DNA, 1374 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425388 - DNA, 1163 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425389 - DNA, 1263 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgtctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425390 - DNA, 1089 bp, Homo sapiens
gactagttctagatcgcgagcgatctagaactagtcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425391 - DNA, 1971 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccaccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425392 - DNA, 1614 bp, Homo sapiens
cgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccaccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425393 - DNA, 1307 bp, Homo sapiens
acgggcagtactctacggtttatggtagcgaggctgggtggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425394 - DNA, 1776 bp, Homo sapiens
  misc_feature (30)..(30): n is a, c, g, or t
cttctttgctcactttactatgggtgtatnttaatcttgtataaaaatatgcatgaatgagccatgcacatgtatacgttatgtatttgacaagtggtggtgaaacaaaatcaaaacagatttgatttgtgtttttgaaatgtcagtacattttgtgccactaacactgtgatgtataaaagagctgttcagagtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccaccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425395 - DNA, 1180 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425396 - DNA, 675 bp, Homo sapiens
  misc_feature (2)..(2): n is a, c, g, or t
  misc_feature (14)..(14): n is a, c, g, or t
  misc_feature (18)..(18): n is a, c, g, or t
  misc_feature (20)..(20): n is a, c, g, or t
  misc_feature (24)..(24): n is a, c, g, or t
gngagagagagagnagananaganagagagagagagagagagagagagagagagagagagagagagagagaggccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425397 - DNA, 980 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425398 - DNA, 1525 bp, Homo sapiens
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccaccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggt

SEQ ID NO: 425399 - DNA, 550 bp, Homo sapiens
tgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacac

SEQ ID NO: 425400 - DNA, 427 bp, Homo sapiens
gagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaa

SEQ ID NO: 425401 - DNA, 4932 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425402 - DNA, 774 bp, Homo sapiens
gcacctattaggtgctggtattcacctctgatgtatcaggtttactgtgtgacaagtcttaatgctcctaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425403 - DNA, 387 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcaggtatgtttctataaactccttaaacttgtcaaatttattgtag

SEQ ID NO: 425404 - DNA, 5052 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggtaccactcacagctcgtagagcagggtttgcccttgggaagaagtgatggcctgttttggcttttgtaggaaaactgaaataatgtgtttctgaactattgttcctgcaccttttctaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425405 - DNA, 5183 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggtaccactcacagctcgtagagcagggtttgcccttgggaagaagtgatggcctgttttggcttttgtaggaaaactgaaataatgtgtttctgaactattgttcctgcaccttttctaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtgaaaaatgggtatgagaattccttgcataacagattaaagaatttgtaaacggcagatttgctataactgaacacttggtctagctgttgccagtatgttactcctttgaaatatactcatgatgtaaaaagg

SEQ ID NO: 425406 - DNA, 3081 bp, Homo sapiens
gcctgttacgtgccaagtgctttttgttaaggacataatgtttttgactggggatcatgtttggctgatgtaaatattaatgccaaaataggagctaggatgaaagtaacactgtaattagtagtagaatttatttcatattaaaatgtgtcatgacgtaatttttatggcttggctcaagcaacaattttcagagtgcaccctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425407 - DNA, 4548 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggtaccactcacagctcgtagagcagggtttgcccttgggaagaagtgatggcctgttttggcttttgtaggaaaactgaaataatgtgtttctgaactattgttcctgcaccttttctaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425408 - DNA, 1654 bp, Homo sapiens
ccaaagtctgatgttgatgtcccctgaagacagcggcttttatgcgaccattgttgcagtggtcgggcttcatgtggtgctggcaattttcgtctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425409 - DNA, 1548 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggtaccactcacagctcgtagagcagggtttgcccttgggaagaagtgatggcctgttttggcttttgtaggaaaactgaaataatgtgtttctgaactattgttcctgcaccttttctaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtaagcaggtcaattattgggtttgcaaatgatgatttcagagagaatagtttttaagaaattagttacctgttaggtttggatttgctttgccagatacttctttcaaaacgataacttgtatttgaaaaatgtaatagaaagtaatgtaataatcatagtaaaaatagttgactaagtcatttatttaacaataaaaaatttctctaacagt

SEQ ID NO: 425410 - DNA, 576 bp, Homo sapiens
gcattgtggtattttcgatttcttgttattgttgtttgtttgtttttcagacagggtctcactctgttacccaggctggagctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtgaaaaatgggtatgagaattccttgcataacagattaaagaatttgtaaacggcagatttgctataactgaacacttggtctagctgttgccagtatgttactcctttgaaatatactcatgatgtaaaaagg

SEQ ID NO: 425411 - DNA, 174 bp, Homo sapiens
ccaaagtctgatgttgatgtcccctgaagacagcggcttttatgcgaccattgttgcagtggtcgggcttcatgtggtgctggcaattttcgtcttcatagtgtggaaggagggcttgccccagtggcgggaaaacaaaaacgaatagagcagcttcttcagagctgcagacgt

SEQ ID NO: 425412 - DNA, 365 bp, Homo sapiens
cactttctgaaatggaacctcaggatcttgagctagaggtaggtgaaataaagggaaattatatggaaacctgatataaatgtaatagcaaatatgaggatttggttcagtagaccagaaacttacatttttagagctgggtaatgtttttaaaataatttaatcctaagattttccaacttagtagtggaactcttgtctcaaaatccatgaaatctagtgtagaagacacataaaggcagggctgctgtggtcgcagtagtgttgggggaatccctggggctctgtccacttgatctctcctgggaagccaccttctgtttccagggtgccctagggctctgcacagtacagtttgaaaactt

SEQ ID NO: 425413 - DNA, 3376 bp, Homo sapiens
gcctgttacgtgccaagtgctttttgttaaggacataatgtttttgactggggatcatgtttggctgatgtaaatattaatgccaaaataggagctaggatgaaagtaacactgtaattagtagtagaatttatttcatattaaaatgtgtcatgacgtaatttttatggcttggctcaagcaacaattttcagagtgcacgtaagtatcaacgcgtaaaacttaacattttacagtgttatttggtattattctctatgaagctgtctggatcggtctccttttcccattggttaattggttaatgctcagattttggctcctagaatcgatctgtgtgttcccggtcttggcatctcattatgtcatttgctgtattttttgatatattattgtacgtgcaaattgaggtgaatttgttgttttagattaagactgttggactcaagctacaacgaggtgtctctgatgtaaaaaactgcagtttaagattatgcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425414 - DNA, 4998 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggtaccactcacagctcgtagagcagggtttgcccttgggaagaagtgatggcctgttttggcttttgtaggaaaactgaaataatgtgtttctgaactattgttcctgcaccttttctaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaaggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagcagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtga

SEQ ID NO: 425415 - DNA, 3659 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggtaccactcacagctcgtagagcagggtttgcccttgggaagaagtgatggcctgttttggcttttgtaggaaaactgaaataatgtgtttctgaactattgttcctgcaccttttctaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatctgcgtggggtgcgagctccattgt

SEQ ID NO: 425416 - DNA, 393 bp, Homo sapiens
agatattaacaattccaccctagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctaggtgagttggagtggtgtccaggtgaccagcttgcttaactgatgttgggaagttgtcatgattaacactggcagttgtccctaaagctgtgggcatggatgcatggcgcgtgactatttcctctatgagctggtagtgaggcaagctgactgaggcacttgccttggatgc

SEQ ID NO: 425417 - DNA, 1262 bp, Homo sapiens
tgcgccgtttcttagcgaaaaagcttttatttttttgacttgggagtacctcttcttgaaattctgtacaactccactgcctcacgttagcgggagcgcacctgaagagtacggggggagccctctctcccttaccctctcactctccaccagatgtttactaaacagggcatgttactgaaatcttcctttgcgactttctcggacatatcaactgcctttctcatgaagaattttaatgggttacagtatgaaatcagttaagataaagctgcattgtatataagtgcaatatatttttgaaggtctgtaaatgtgtacatacatgtcttatataaatatataatatataaatatggtgtctgtgtacatatagtgaagatatgcagtaagagctaccttaaagactttccctagacaaaggttaagttattttttgatcgtgtataccaagcagatagaatactgtgcttagtggaacccgctaaaaacctttttctctgtttttccaaacacaggcattctgtagcatagcaaaaccttctcaaatgacagagattctgtttgctgttgagaatgttgttatttggatttctgcactgtttaacaaatgaagtaaaagaaaaacactactgcaatcacgtcttttgttatgctagtatcagtcagatgcacttagagtgaagaaacactgtaattacagcacacagattgcaagtattgcgtaccaagtgatacaactcgaaatgcagttctcatcttcctgttttgagaaatgattattttatcacgcatcagagccttcgtgctttgattatcttgtatgttaacaattctagaaaacattcatgaattcacaaaaatacgttactatggcaggggaacattttgtacacatttaagtatataaaaatactaaaatatgtaattttataacaaagtcacgggtatctttaggttcagggaactagactaggtcattcgtgtaaatggactggtagttacagtcttaggttaaagtattctaatgaagtatgggaactaaattgctggttttctaagataagatatgggatatgggtcatataacttttgtattttttatgaagttgattttgtcttgcgtgttatttttaattgtatcattgaagatgtattttaaaccaaaggaattaaattttatatgtctatttcgtaatatgtcatttcctgtttttcaatttgactttgcactgctcagtaaaacgtgagagctgaaaagc

SEQ ID NO: 425418 - DNA, 3600 bp, Homo sapiens
ccgccgctccggacccgcagccgccgccgccgcctcctccccccggatcgggtgtactgtcctaacccgaaagtccagttctgcggcccggcagcggcgagcgggcgcgatgacacaggagtacgacaacaaacggccagtgttggctcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctctctcccttaccctctcactctccaccagatgtttactaaacagggcatgttactgaaatcttcctttgcgactttctcggacatatcaactgcctttctcatgaagaattttaatgggttacagtatgaaatcagttaagataaagctgcattgtatataagtgcaatatatttttgaaggtctgtaaatgtgtacatacatgtcttatataaatatataatatataaatatggtgtctgtgtacatatagtgaagatatgcagtaagagctaccttaaagactttccctagacaaaggttaagttattttttgatcgtgtataccaagcagatagaatactgtgcttagtggaacccgctaaaaacctttttctctgtttttccaaacacaggcattctgtagcatagcaaaaccttctcaaatgacagagattctgtttgctgttgagaatgttgttatttggatttctgcactgtttaacaaatgaagtaaaagaaaaacactactgcaatcacgtcttttgttatgctagtatcagtcagatgcacttagagtgaagaaacactgtaattacagcacacagattgcaagtattgcgtaccaagtgatacaactcgaaatgcagttctcatcttcctgttttgagaaatgattattttatcacgcatcagagccttcgtgctttgattatcttgtatgttaacaattctagaaaacattcatgaattcacaaaaatacgttactatggcaggggaacattttgtacacatttaagtatataaaaatactaaaatatgtaattttataacaaagtcacgggtatctttaggttcagggaactagactaggtcattcgtgtaaatggactggtagttacagtcttaggttaaagtattctaatgaagtatgggaactaaattgctggttttctaagataagatatgggatatgggtcatataacttttgtattttttatgaagttgattttgtcttgcgtgttatttttaattgtatcattgaagatgtattttaaaccaaaggaattaaattttatatgtctatttcgtaatatgtcatttcctgtttttcaatttgactttgcactgctcagtaaaacgtgagagctgaaaagc

SEQ ID NO: 425419 - DNA, 2096 bp, Homo sapiens
ccgccgctccggacccgcagccgccgccgccgcctcctccccccggatcgggtgtactgtcctaacccgaaagtccagttctgcggcccggcagcggcgagcgggcgcgatgacacaggagtacgacaacaaacggccagtgttggctcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtaggtaaccaggatcccaggggaggttaccaggaaggaaggcatggcaaaaggaaattctttggcattattcatggggaaacagaagccaaaattgagtgaggtttgaccagttagtcagctctttgggaatattctgctggggtgacatgatgcccgtgcaataaaaatggtaagcatcgctgatttcaaggtgcagtgcagcctgtcagctttattctgtttgtattcattcattcattcgttcgttcttcatacctacatatcctagctcatttaaaagattctagaatagtagcataatttggagtttgagcctgtcatctttttaaacttaacttggggcaatacctaggttaaggagctcttataacataagaacatccgaaggcttttctcacagttccagttactgagccgtccttgccacgtgtagttaccaatggccatgtcttggcaactaaaactaaattttaaaaaatggtcacgccctgttttgtggcaaaggcttacaagggatagaaacttcagtagaatgaagcatggttttatgctgagtgcaaataaatatcaaaaagacagtctttcatgcactttgtggac

SEQ ID NO: 425420 - DNA, 2173 bp, Homo sapiens
ccgccgctccggacccgcagccgccgccgccgcctcctccccccggatcgggtgtactgtcctaacccgaaagtccagttctgcggcccggcagcggcgagcgggcgcgatgacacaggagtacgacaacaaacggccagtgttggctcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtaggtaaccaggatcccaggggaggttaccaggaaggaaggcatggcaaaaggaaattctttggcattattcatggggaaacagaagccaaaattgagtgaggtttgaccagttagtcagctctttgggaatattctgctggggtgacatgatgcccgtgcaataaaaatggtaagcatcgctgatttcaaggtgcagtgcagcctgtcagctttattctgtttgtattcattcattcattcgttcgttcttcatacctacatatcctagctcatttaaaagattctagaatagtagcataatttggagtttgagcctgtcatctttttaaacttaacttggggcaatacctaggttaaggagctcttataacataagaacatccgaaggcttttctcacagttccagttactgagccgtccttgccacgtgtagttaccaatggccatgtcttggcaactaaaactaaattttaaaaaatggtcacgccctgttttgtggcaaaggcttacaagggatagaaacttcagtagaatgaagcatggttttatgctgagtgcaaataaatatcaaaaagacagtctttcatgcactttgtggac

SEQ ID NO: 425421 - DNA, 476 bp, Homo sapiens
cctcgttttccccctaggcagacctaaatcaagcagcttaccacaatagtgcatgctgagtagattagttccaaggaagggagactggaatgctggtgtcaaggaaaagcctccctcatcatctagtctaagaccataacgggcagaagcataagaggttccagggccataggagaatgagaagtagggcacatatagggaggaaagaaaagtgaagaagggggaaatctctgaatttttttactgctgggaaaagtgtactacatgaaggatgcttggggctttgctaacctgctcaccgctaaccctccaagtctaaccatccccagaggccacacaaaccaagtgactcctgtagttcccatttgccccactatggagtcagggcaaaagtggaatagccactccatgtgattttagcatgtttaatcattttaacaataaaccaccccacaaatggggtcatttaacctcta

SEQ ID NO: 425422 - DNA, 322 bp, Homo sapiens
ctcctcgaggattcccgccagtctgcgtccatcagctgtggaataatggcaacagaaagactggctaactacaccggaggcatctatgccgaataccaggacaccacatatataaaccatgtcgtttccgtggctgggtggggcatcagtgatgggagcaagacagtcttcgtcccatcaggagagccaccggctgcccgtggaggtggcttacaagcgcggcctcttcgatgaggagatgaacgagatcctgaccgacccctcggacgacaccaagggcttctttgaccctaacacggaggagaacctcacctacctgcag

SEQ ID NO: 425423 - DNA, 710 bp, Homo sapiens
atccacctgcctcggcctcccaaagtgctggaattacaggcgtgagccacggcgcccagccatatcagattatttctaatgacggtaaattctctcaatttaaaagtggtaattcttaactgcttgctctcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatgggtaagatgttttcattttcttaaggtcattcctagaaaaaaacgtcctggtactcctctcgcttgaatggttctgtttacgtttagctaaaaactggggccttgacagagggttccttgctccagctgtctcagccaccgcgcgagtggcttttggggccagacccttctctgacatgcgcggctgccgccatcctgtgcactttgggtgttcagcagcatccctggcccctccacccactaggtgactccccgcaatcccagtgtgaccaaaaccgtctccagatggtgcctggtgccctggggaagtccctgtgagcactgctggagaggggctctgccaccctcttcctttacaaccagctcattctttttcccatcatggtttttgggctcccctaaaatactgtgtcgg

SEQ ID NO: 425424 - DNA, 1616 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425425 - DNA, 1992 bp, Homo sapiens
  misc_feature (1545)..(1545): n is a, c, g, or t
  misc_feature (1547)..(1547): n is a, c, g, or t
  misc_feature (1551)..(1551): n is a, c, g, or t
  misc_feature (1556)..(1556): n is a, c, g, or t
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtcntntgcnttatntgtgtaactgtatgactggattgccagatccagtcctgcagactatgccatgtccaaggcggaacctgaagttgacaggtcccgcttaacatatgccaactttgctgatgtgaatgctgcaaatgcttttgagggttttgatttaggcgttgatcctatcgcctagtttttcacatccattatgccttgcagttcagtccttggcacagtggcttcgataattttgagggcatcttgctttaccagttagtacctgcattgtccttgtctacgtcttacgatgcccttcttacagttattttattatgatttatattgttcttcccctcaccctatttcatctttcttgtttcattacgacactttcacttcttgaattctctatcctctactctttgctcggtcacttctccctacatctctctctatccttccc

SEQ ID NO: 425426 - DNA, 1512 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaacttttcaaatcgcccaagtgatgaataaagtatctggctctgcacgaga

SEQ ID NO: 425427 - DNA, 1455 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatgggtaagatgttttcattttcttaaggtcattcctagaaaaaaacgtcctggtactcctctcgcttgaatggttctgtttacgtttagctaaaaactggggccttgacagagggttccttgctccagctgtctcagccaccgcgcgagtggcttttggggccagacccttctctgacatgcgcggctgccgccatcctgtgcactttgggtgttcagcagcatccctggcccctccacccactaggtgactccccgcaatcccagtgtgaccaaaaccgtctccagatggtgcctggtgccctggggaagtccctgtgagcactgctggagaggggctctgccaccctcttcctttacaaccagctcattctttttcccatcatggtttttgggctcccctaaaatactgtgtcgg

SEQ ID NO: 425428 - DNA, 1165 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggagcaagacagtcttcgtcccatcaggagagccaccggctgcccgtggaggtggcttacaagcgcggcctcttcgatgaggagatgaacgagatcctgaccgacccctcggacgacaccaagggcttctttgaccctaacacggaggagaacctcacctacctgcag

SEQ ID NO: 425429 - DNA, 903 bp, Homo sapiens
ataccctgaccctttttggtgtatcccaacccttacgcttgattgggagcccggctgcgcctcttgctcccctccgattctccgattccctctgccatgaaatttccgaaccaactttttttttttttttttttttctctgatgggacgaagatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425430 - DNA, 890 bp, Homo sapiens
  misc_feature (146)..(146): n is a, c, g, or t
tcatcttcgtcccatcagctgtggaatatggcaacagaaagactggctaactacaccggaggcatctatccgaataccaggacaccacatattaaccatgtcgtttccgtggctgggtgggcatcactgatgggagcaagacggcncatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425431 - DNA, 814 bp, Homo sapiens
aagagatccctcctatacctgaaaatagattcctaatgagaaaaagtcctcctaaagctgatgggagcaagatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425432 - DNA, 722 bp, Homo sapiens
agctgaggggcagctgagtgggctgtctggatcccccaaggctggcctgagagatggaggcagaaagcagggggcagggggctgacggcagcaaggggagcgggagacggctgcagatgggctgacgcgcgatcccacttctcacagggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425433 - DNA, 1152 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcgggtgagtggccgcctttgactgtgggccaggaaagcccatcccggctgcctgtttataggcccaggcagctcagcccgcggttccaggggcctgtgattcaaggccaggtcagcctgggctggggtgctaaggccgaggagcgcgggcctttgccctctgctgaggtgacccaagctgggtcattctggggcttttgggtgacaggcaggactaggactgaatcccagtgacaagtggctgccaggtgccctctctcccccaaagcttgtgacctcagccattgggatagaaacagaaatgcaaaatcactgagtccccaggctgtatttgaggatacagaagtaaactgcttctcagcacagatgaaagcctgtcctgggcttggaatattgggtgaggctagttggctacagcccatggcctaacctggtcactacctccagcctggtgggtttctatcttaggcttttggcaggaggagggtagggaggctcttagcaaagaggaaggggaaactaaggccctccctatcaacgaggctgctgcaccctgctttgggagagaaggcgggagaagggacagctgcaaaccagccccaggcccac

SEQ ID NO: 425434 - DNA, 557 bp, Homo sapiens
  misc_feature (36)..(36): n is a, c, g, or t
ccttgcggcgcgagcacttgcggccacagttgccanaatacaaatatcaagtactctgctgaagaagactgaggtggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425435 - DNA, 703 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattg

SEQ ID NO: 425436 - DNA, 502 bp, Homo sapiens
  misc_feature (8)..(8): n is a, c, g, or t
ggatcttnaggtagactaacccaggtcgtgggtgttgagcttcgacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttaggtctacctggcaggtagacctaaccatcttctccttacacctagcaggtgttctcctctatcttaggggccatcaatttcatcacaacaattatcaatataaaaccccctgccataacccaatagccaaacgcccctcttcgtctgatccgtcctaatcacagcagtcctacttctcc

SEQ ID NO: 425437 - DNA, 1580 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgactgatctataggagtactgatctataggagtggtg

SEQ ID NO: 425438 - DNA, 2116 bp, Homo sapiens
aaatggtgaaagggggggaggggagaaaagaaaaaaaaaaaaagaaaggggaaaggggggaaaaataagaaaaagcgagacagaggcgctgccgcgtccgctcgcggggaaggctggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcaggtgggcaccggcggggaggcagccctggggggacgggaggcccatcgcccgggccaggcgcgcgctctgcctcctgggggccctgcgtcgccaacaggccttggaaggtcagatccagccgcttcgttttgggggtcgctccttctcttccacatccagggtgagccctgatgtttgtggggttggacaagccccacctggccagaaagccaggccagccccacctcctcggcctctgggggtggcccttacggcgcggcatggctgggggagcaacccggttccctcctttcgggggtgccctgcctccttcacattctgagagcgctggagcctcctagtgtgaggtgggcccacacctggctcacctctggtgattgtggccccactcccatgccctcaggtgttgggaaaggcgggagggccctaccgagggcttcctgggcccacggcccccgggagccccagcaccgatctggggggggatgatctcttctcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425439 - DNA, 1168 bp, Homo sapiens
ctcagaggaccccaaagattttgagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425440 - DNA, 773 bp, Homo sapiens
ctcctcgaggattcccgccagtctgcgtccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425441 - DNA, 1093 bp, Homo sapiens
  misc_feature (349)..(349): n is a, c, g, or t
tgaaactcctaacctgagttgttgatttatggcgtctcctctaccaggcttactacttttgcatttatgaatctctattatatgagattgatctgtgtcaccccaaaattcatagtttgaactcctaactgccagtacctcacatgcgatcttatttcgagatagggtctttatagaagtaatcaagtgtattagtccactctcgcactgctataaacaaatacctgaagctgggtaatttataaagaaaagaggtttaattggctcatgattctgcaggctgtacaggaatcctggctggagatgccttgggaaactcacaattatggctgatgggagcaagacggcncatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425442 - DNA, 896 bp, Homo sapiens
gtctagaggatccctcttcgtccatcagccagattcacacatcccttccaccatatggagaagtggcatttgaattggcgttaacggacagcacggtttggagttgggcagctgggcaatggaaataccgatcctgatgggagcaagatgcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425443 - DNA, 717 bp, Homo sapiens
  misc_feature (8)..(8): n is a, c, g, or t
ggatcttnaggtagactaacccaggtcgtgggtgttgagcttcgacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 425444 - DNA, 1123 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagccatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagct

SEQ ID NO: 425445 - DNA, 5205 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425446 - DNA, 4698 bp, Homo sapiens
tcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatgctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425447 - DNA, 4878 bp, Homo sapiens
tcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425448 - DNA, 5205 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425449 - DNA, 4721 bp, Homo sapiens
  misc_feature (4661)..(4661): n is a, c, g, or t
  misc_feature (4671)..(4671): n is a, c, g, or t
  misc_feature (4698)..(4698): n is a, c, g, or t
  misc_feature (4715)..(4715): n is a, c, g, or t
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttacttgtccaaagacaaaatgggaagatggattaaatgagtgctgagatttctcttgttgnaacaatctgntaggcaacaagtggccacattacaagnaaccttaccttccaaanaagcca

SEQ ID NO: 425450 - DNA, 3644 bp, Homo sapiens
tgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425451 - DNA, 3208 bp, Homo sapiens
ttgagatataataactcatctagattaccaattaaagtgattatatgtaaactttaggagggagataaaagtaaaaatagatatatcagaagcactagtaatttctttaattgcaaactgtgtttccagttaaaagcatcatatataataatggtaacattaatagataaatggcaggcacacagataaataggtgataaagagtttctggggtatacaaaaatgtactccatccaataaacgtaaatgcgtgtatcactgaagttggacctagagaacaccacacaaatcattaacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425452 - DNA, 3314 bp, Homo sapiens
acgattcatcagataggatttttgcaaaatcccacccatatgctgttgagcaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425453 - DNA, 2910 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactggccacaggagatccagtacctgaaagatttgactagaagaggtccgcaaggcaagggggaagaaaaagggtcccctagttgaggatagtcagagcgtcaatgtgctgtacatagagtgctgcatc

SEQ ID NO: 425454 - DNA, 1684 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagcgactaccgcgttgtggcatgctgctttggcttgcaagaaaaaatgggatctc

SEQ ID NO: 425455 - DNA, 1468 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagct

SEQ ID NO: 425456 - DNA, 5449 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425457 - DNA, 5154 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425458 - DNA, 5395 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425459 - DNA, 3603 bp, Homo sapiens
  misc_feature (3)..(4): n is a, c, g, or t
ttnncgctctcggaagcaggtcctatctcgctgaggtgggggtcatcattgttatactgtttctccaggtctctcacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425460 - DNA, 2805 bp, Homo sapiens
aaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 425461 - DNA, 1101 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttgtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaaactaaactgaaacattagctcttcctggattttggacctgttggtcttcagattcacactgaagttcttgggacttgtcagcctctatattcaagtaagccaattccgtataataaatctctttctttctttatacattccat

SEQ ID NO: 425462 - DNA, 559 bp, Homo sapiens
gagaatttttattttaaaattatagggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtaagtatatcttattttatacaaattctaaatattttgagagtttcaaaaattaaatataataagatattaacaaaaaaaaaaaaaaaaaaaaaaaaaaaattttgggggggccgggcccgaaaagagtattttctgaaacctttcccgtgggggcggcgggggccccaattgggtaaggtggacatgggggcaaggacttggtgcccaggagaaaccggggcagaggaacacgtgtggggttttccaccgaataaaaaaaggccgcgggggacaccgagcttttttggacaaatccccaaggggagtccggaggaacacaggggttcttaccaggggtccaaggaatcgtataattagca

SEQ ID NO: 425463 - DNA, 3806 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaaatcgtgccactgcactccagcctaggtgacagagtgagactccgtctca

SEQ ID NO: 425464 - DNA, 3830 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacgtgagagacaatcctgacttttggggtcctctggctgttgttcttttcttttccatgatatcattatatggacagtttagggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaaatcgtgccactgcactccagcctaggtgacagagtgagactccgtctca

SEQ ID NO: 425465 - DNA, 3712 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttgtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaaatcgtgccactgcactccagcctaggtgacagagtgagactccgtctca

SEQ ID NO: 425466 - DNA, 3558 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaaggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaaatcgtgccactgcactccagcctaggtgacagagtgagactccgtctca

SEQ ID NO: 425467 - DNA, 1050 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttgtatgtaaaaataataatatatattttttgttttttgagctagtctgtgggatgattatattcttcttgttatttagagagaaagcattaaccttttttggtcaaaagctatagtgattgtcaattttactagtaatttaaaaaactgaaataataatgagagaatattttttaaccaattaaaagacaaaaattaaaagaatggtaatcctgtatctcacacacatgtgtgtctactccagcttacctgggtctgtcagctatctgaagtaatcatgcaattt

SEQ ID NO: 425468 - DNA, 2215 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtg

SEQ ID NO: 425469 - DNA, 3884 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaaatcgtgccactgcactccagcctaggtgacagagtgagactccgtctca

SEQ ID NO: 425470 - DNA, 1782 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttccaaaaaaaaaaaagaaacagacacaaacacacttctggcgggcccggcctgggccaaggagaaaagtttctaaacaccatctcgctgggggcgggcggcccatttgttcagtgccggcggccaagcaggggcccaaagagaacgcgcgcatagatcagggcgtgggtcctcccattagaaaaccgcggcggcaccgactgcttgaacactcgagggttcggcgccacgggctacaacggggccacgaagcgata

SEQ ID NO: 425471 - DNA, 2268 bp, Homo sapiens
tgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaagtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaaatcgtgccactgcactccagcctaggtgacagagtgagactccgtctca

SEQ ID NO: 425472 - DNA, 4190 bp, Homo sapiens
tactttcagagaaaatctttccaaagaccctcttaagaaagtcctatttctaaaattttcatgtttgattcattcagatatgattaaagcccatcatggtctgtgtaaatgtttctgcattcttagaaactttctccagttttttataactagtccattggatgtaggaatgccaaagagtctaactaaaaagagagggaatcttggctacaatggaatacctaggggtatgggaagtaagtaatagtctttatttccatatgaatattgctggctttacacctgcaataattaggcaagagactcaaagatagttttttcagaaaagttttctttcaaggatctagcaagtctgagctatgcttccaactttactgccctccatcatccggcatctttgactcatccaccaccttctgtccctttcattctcattccccatgtgtcagctccccagaaaggacatatcttgtacaccttgccacagcactcatcacctgcttctggactgcctgagcaagagtgatacttcctgttctaaagacaggagtgaggatgggggatactcagactttgggatgtgccagaactgtggctagtccccaggaagcagaacttggaggactcataaaggagccaatcccacctccatcctaaacaaggccagttcataaaccccatctggcacagcagcagtctcaggaagctaaattggggagtgccctgtatctcactccctaaactggggagtgagagcatcctgatggtcagctcttgggctgtgacagtggtcccctgcaaatgaaaaggggagctgtactgatgtcaggagatgtggctcaccgtcattattagagtcagggcctctcctgcctacttcggtgggtgaggacagagagggggatggagagaatccttaatccttcattggtaacatcctgagatcctcctagagttccagacatcatacttatcatgggatttgtttgccttattttagcctccctgccctctggccagtgagttgaattaaataattgtgccctcagtatcaaggagtagacaatgtagactatttttatgcagccctgaggacccccagtcatgactcttgataaggtgaggcatctgggttgggtgctaaactatgagccttcttcaccctccttccagtaatgcctatttcagccctgcctagcctgcaccatcttgataattaggtaggatgactgcagattgaaatcaagcagctatttcctttggcttttctggcagacactgcccactgcctccagtgcgtgcactgtagatggtgggtggtccctatgggtgggtgctagggggaaaattccacccctgcagtaagcagaagcaggcagaagtctgctggaagctgcaggcctcccgcactgacttgcaatgttccttgtgctccaggtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaag

SEQ ID NO: 425473 - DNA, 1172 bp, Homo sapiens
aatagttctgcctgcttgcttctacctggcaaaacgtcctttgcattatctgatcaaattcaatcaggaagtaagtcctgccggtatccacagatctgatattagagtacaacatattgtactgtcataggttttattcagtgtgcttgttcaacacagtaaatgtagactgttgcattgactactatgtgcatgcagcagcactcttcctgccctttcagtactttaaatccaagcttgtgacaatccttacgtaaatgctacataaacattacaccgcaatggttcaggagttatgatagcgtctcctttttctctggctgacctcttttattatggtgggttttgttgtgggtatgtgaaaaagaagggctacttagtaactagcaggttagaggaacagatcccattttgacagtggagagagtcatattgactattaaaagcttttaaatggtaacagacatggtatcctaccccaaaatgtcacttactcttttttgtgtttttgtatgtgtagcataggtgttttgttttgttttgttttcattcgccatgtgaaaagagatgcgtagcatatgtttaagggaaagaatttattctttgtaattttgtactaggtggactgttcccttgcaaattctccaatttgactaggaaaatatgaatcaaagatcagtaaaggtaatctctcatccttccaaaagaaccatatttaaactaactcaataccttataatacacggaaaaataaacgcagaatttaagagtcaaatcatgtgaggtctgaagaagatatgcctccagtaaaagagtgttttggatttgtttgtatctagactgtaagggaatacatttaaaggacataaagccttagaaaaatatattgtggctggctggggtcggtggctcacacctgcactttgggaagctaaggcggtggatcacctgaggccaggagttcaaaaccggcctgaccaacatggtgaaaccctgtctctactaaaaatacaaaattagctgggcatggtggctcatgcctgtaatcccagctacttgggaggctgaggtaggagaatcgcttgacccaggagtcagagtttgcagtgagccgagatcgcaccactgcactccagcctgggcaataagagcaaaactctgtctcaaaaaaa

SEQ ID NO: 425474 - DNA, 576 bp, Homo sapiens
ggtgggtacccactcattagacaggtggactgttcccttgcaaattctccaatttgactaggaaaatatgaatcaaagatcagtaaaggtaatctctcatccttccaaaagaaccatatttaaactaactcaataccttataatacacggaaaaataaacgcagaatttaagagtcaaatcatgtgaggtctgaagaagatatgcctccagtaaaagagtgttttggatttgtttgtatctagactgtaagggaatacatttaaaggacataaagccttagaaaaatatattgtggctggctggggtcggtggctcacacctgcactttgggaagctaaggcggtggatcacctgaggccaggagttcaaaaccggcctgaccaacatggtgaaaccctgtctctactaaaaatacaaaattagctgggcatggtggctcatgcctgtaatcccagctacttgggaggctgaggtaggagaatcgcttgacccaggagtcagagtttgcagtgagccgagatcgcaccactgcactccagcctgggcaataagagcaaaactctgtctcaaaaaaa

SEQ ID NO: 425475 - DNA, 4371 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaag

SEQ ID NO: 425476 - DNA, 4622 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagagccttaggactgttacagctgagcattatgatgttaacaactcagccatctggcacaggggaagaggcacctaaacagattcttctggacaaaagtcacatatgagcaagatcagaatagtagcagatgtaaaaagcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaag

SEQ ID NO: 425477 - DNA, 2628 bp, Homo sapiens
cagagtattccatgcacgagcgagttagaggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaag

SEQ ID NO: 425478 - DNA, 1880 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagagtactgtttagttctgaccgaggctcagggtttgctagttgaaggggctaagtttgcgcagagataatctgcctccttgtgacctgcgtgcagtttcctaacatgctgcctgccatccagtaggagcacagacagagattgcacactcctcctggccacaggatggccacagctccacatagagctcagtgcaggagacgtctgcccctcctcatttctgggacctttactctgagaggagctttgaaacaagcaagtgcaaaactgaaaatagattccttagcgtcttctgttctatcacctagtcactgcggctcacctcttctcttaattctgtattccatattaaaagtttttttctttcagta

SEQ ID NO: 425479 - DNA, 1767 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagccaaggtctttaacaagcagagtgttttgtccagcagtgaggccccttttcccacttcccagcacccacataaacaggaataatgtgctggaaatgaaaccaggtggcagaagcagctacacatgcaagagaagcctgattgggtccacattaaccagatgacaggagtgagagccttcacttacatttcggggaccatcagtgagaactgggatggcagtgaacctgaaataaagatcgttgaaataagactggc

SEQ ID NO: 425480 - DNA, 769 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtaagtcaagtcttttctctccacttacttagtatgtatcttagctggaagccctaaaatatacaaatttttt

SEQ ID NO: 425481 - DNA, 379 bp, Homo sapiens
ccatgttgctcagtctggtctcgaactcctgacctcaggtgatccactcacctcggcctcccaaagtgctgagattacaggcacgagccaccgcgcccggccctggttttttgttttcgaaggtaagctactctccaatgaactattaaggaccaggctgcctcccttttgcagatgagcaaactgagaagacaagacaacttgaaagtgctcttggtagctgaaaataattactactactctattagaattagaatcattctgtcctttgcatatgcatcaagttggacctgtttcccccatttgactttttgtttcatttttctagcctactccagtagggtcagttcacgtagattctggtgcatctgcaataact

SEQ ID NO: 425482 - DNA, 3068 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaag

SEQ ID NO: 425483 - DNA, 4499 bp, Homo sapiens
catgtatccaaggcacgaaccagccatgggcacagaccaagagccaagatgggataaacaagggttgctttatccctggatgacatgagatggacatcaccacattaaaggttcttaagctagagagtaacaggaagtatctgtatgtattcaaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaatgcagtgtctcatatgttgcttagctgctctcaaactcctggcctgaaatgatcctcctgccttggcctcctgctaaagtgctggcagtaataggcataagccactgtgactggcccaatattcttccaatggcatatatgtcattatggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaag

SEQ ID NO: 425484 - DNA, 1946 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaggtggactgttcccttgcaaattctccaatttgactaggaaaatatgaatcaaagatcagtaaagagtactgtttagttctgaccgaggctcagggtttgctagttgaaggggctaagtttgcgcagagataatctgcctccttgtgacctgcgtgcagtttcctaacatgctgcctgccatccagtaggagcacagacagagattgcacactcctcctggccacaggatggccacagctccacatagagctcagtgcaggagacgtctgcccctcctcatttctgggacctttactctgagaggagctttgaaacaagcaagtgcaaaactgaaaatagattccttagcgtcttctgttctatcacctagtcactgcggctcacctcttctcttaattctgtattccatattaaaagtttttttctttcagta

SEQ ID NO: 425485 - DNA, 1411 bp, Homo sapiens
ttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaaatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagtaggagatggcaacctaccttcgatcttcagaataccctggattcagtagaaaaaccttttaaatgaagttttgtacaatagaaacttctcagcagtctaaatttagactgtaaaataatacatgcgaaacatacttttctgaaaacacttaacttg

SEQ ID NO: 425486 - DNA, 4813 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagacggagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425487 - DNA, 4372 bp, Homo sapiens
  misc_feature (1)..(1): n is a, c, g, or t
ntgagcggacctccataatgtgtgccaggtctgggcagatgcagggaggtgctatccatgagtgaaggcagtgtcttcctcacctgggtgggtcccacacttgtgacctcagttttaggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425488 - DNA, 3837 bp, Homo sapiens
agtagagacggggtttcaccatgttggccaggctggtctcgaactcttggcctcaagtgatctgcccgccttggcctcccaaagtgctgggattataggcgtgagccaccatgcctggccccttaccattccttgttattggtggtggacacctctgacttcctggtggtgaggtggcacagagggcattgactgcatcctgtaatgccttgcgccttgggatcaatcattccccaccttggagacacaggtgcagtccccaccttggagacacagaccttggagaggccagctctgaccatttccttctgtctgtcacataacctagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425489 - DNA, 3232 bp, Homo sapiens
tgtggtgatctagaggtccctaggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425490 - DNA, 4691 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagacggagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgctctgtgcaagaagtatgctgaactgctggaggagcaccggaattcacagaagcagatgaagctcctacagaaaaagcagagccagctggtgcaagagaaggaccactgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425491 - DNA, 958 bp, Homo sapiens
tagaactcgagcttgtaccgcggattgtgtccgcggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425492 - DNA, 3383 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagacggagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccatcgaaggccacaggagaagaaaaaagccaagggtttggggaaggagatcacgttgctgatcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425493 - DNA, 1605 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagacggagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaaggtaactgtggtccaggccaggcatggctgctggggcataagctgcttcattcaaaattgttgggcctgccttcaggaagctcccatctggggtgtctcaagggcagggctgttaggaaggttcacagcctttcccctcttgaggcagtatcagtggtatgtatacactccaggttgtcccagggaatggggcagtcttttttgtttgtttggtttttttggggggtttgttgttgttgttgttgttgttgttgtttgagatggagactctagcctgggtgatatgccgaggctccatctca

SEQ ID NO: 425494 - DNA, 388 bp, Homo sapiens
gcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggtaggcctgggccccctggaacaggtgactctggtttccttgacttccacttaatgtttctttcatgggctttcctcttaaaaagtagtgcaggctagggccaggcgcagtggcacacataagtgattaaaaatcttctggccactaaaaaacagaaattaattttagtaatatacttaacccaatatccaaaacattacaatttcaacatgaaatcagtgtaaa

SEQ ID NO: 425495 - DNA, 600 bp, Homo sapiens
gattcaggcacagaggcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425496 - DNA, 4293 bp, Homo sapiens
tcccagatcctctttccatcaggattcaaaggaaaacgggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425497 - DNA, 3595 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagacggagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttgccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425498 - DNA, 3626 bp, Homo sapiens
cacacaaagaagccgcagcgtcggagagactccggaagaagcagctggctgaacaagaggaactggagcgacaaagtgaaggaactccaggccgccaacgaaagcaagcagcaggagctggaggccgtgcggaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425499 - DNA, 3503 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagacggagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccaggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcgaggatggggcacagggtgagccggctgaacccgaagatgcagagaagtcccggacctatttggcaaggaatggggagcctgaaccaatctccagtagtcgatggagagaagaactcttatggggatct

SEQ ID NO: 425500 - DNA, 1199 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagacggagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctt

SEQ ID NO: 425501 - DNA, 1233 bp, Homo sapiens
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattc

SEQ ID NO: 425502 - DNA, 1090 bp, Homo sapiens
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcggatcacttgaggtgagggattcgaaaccagcctggccaacatggtgaagccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctg

SEQ ID NO: 425503 - DNA, 5070 bp, Homo sapiens
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccactctgactcccaggacgggcaccagatggccctattgaatttcttcttccctgatgaaaagccatactctgaagaagaaagtaggcgtgttcgccgcaataaaagaagcaaaagcaatgaaggagcagatggcccagttaaaaacaagaaaaagggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgctgctgataaagctggaactcgagaaaaccagccagctgtggtgcatctacagggccaagggtcagcaattcaagtcaagaatgatctttcaggtggagtgctcaatgactggtctcgcatcactatgaaccccaaggtgtttaagctacatccccgcagcggggagctggaggtactggtggacggcacctacttcatctatagtcaggtagaagtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacagacagaattttccatttattaagcagtacagatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtccccatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcaagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctaagagggcgagggatgatgagggaagcaataggtagctggggagccctattgctgctaagtcattggcaaagtgcaaagcaatttactgatgagagaatgtggaaatagatgtgcagtttggaattatgttggtgtgaatttgccagaggaccaatgcttgcatggagaatggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatcctgtatgagtgtatgtgtttatgtaacttcctgtggagtgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtcaaaattgaaa

SEQ ID NO: 425504 - DNA, 5280 bp, Homo sapiens
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagatggccctattgaatttcttcttccctgatgaaaagccatactctgaagaagaaagtaggcgtgttcgccgcaataaaagaagcaaaagcaatgaaggagcagatggcccagttaaaaacaagaaaaagggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgctgctgataaagctggaactcgagaaaaccagccagctgtggtgcatctacagggccaagggtcagcaattcaagtcaagaatgatctttcaggtggagtgctcaatgactggtctcgcatcactatgaaccccaaggtgtttaagctacatccccgcagcggggagctggaggtactggtggacggcacctacttcatctatagtcaggtagaagtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacagacagaattttccatttattaagcagtacagatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtccccatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcaagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctaagagggcgagggatgatgagggaagcaataggtagctggggagccctattgctgctaagtcattggcaaagtgcaaagcaatttactgatgagagaatgtggaaatagatgtgcagtttggaattatgttggtgtgaatttgccagaggaccaatgcttgcatggagaatggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatcctgtatgagtgtatgtgtttatgtaacttcctgtggagtgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtcaaaattgaaa

SEQ ID NO: 425505 - DNA, 1141 bp, Homo sapiens
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggcctgttttcctcaggtcttgctaagcctgtgacctgtcagctatgcttagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcggatcacttgaggtgagggattcgaaaccagcctggccaacatggtgaagccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctg

SEQ ID NO: 425506 - DNA, 1268 bp, Homo sapiens
gccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggaggtgggctccgggcgcggcgaacaggcctcgggggacccggcgctggcccagggtctcctggagggcgcggggaggcccccggcggcgcgggcgactcgggccgaggggcaggacgtagcgagccgctcacgttctcctctggcccgcgagggcgccgggggcggggagcagctggtggaccagctcatccgcgacctgaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacaaaccaactggaaggtgggcagtggccaatatcattacctgtgaaagaatagcctgcaaggacatgggaatccaagctttcactcatagcctgagattaattgccaacagcgaagggagaggggtacactgagcctccccttcagctgttggtgacttgttgcccattttgttcaccattagatgatctgcctctgttttcagcctcaagatttgggaacatcctcttattctgcaggagaggaagggtgagattgggttgccagccacttcctctcggattgttagggtggtcagaggagtgctctgtgcagcccctttgactttcaccgactctctggagggacccagaaagcaaaagcactacctgcatacaaaagaggagctgaaaatgtcatttctagtaaatgtaagagggagatgattaaacatctctaagcactgtcttctcttccctcacataacctattggcgtgcttccataacatttatcacttcaaagtctctacggaaatattagatcacagctaagaatttgcacagtgaagtgtttccataggagataactgtcaagagccgtgttacataaagctgtttgaggcatgacgag

SEQ ID NO: 425507 - DNA, 6332 bp, Homo sapiens
gccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacaaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctacgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccagaaggttttgttttttttcaggtggggtctcgctctgtcacctagactagactggagtgcaatggcctgatctcggctcactgcaacctctgcctcccgagttcaagcaattctcctgcctcagcctcctgagtagctgggattacaggcgtccgctaccacaactggctaatttttacatttttagtagagacgggggatattgctatgttggccaggctggtctcaaacttctgacctcaaatgattgcctgcctcagcctcccaaagtgctgggattacaggtgtaagtcactgtacccagcccaaaagcagtttaaaaaaaaaaaagacaaaatatacaactcttgataaaacataaaggtacagtggtctatgaggaagagaaaaggtacctgaggatgcagaagtacctaccacatgggaaccgtttgtccacactcattccagagaaaaccgagtcctctcagttgcacacgtgtacgtatcagtgggaagtgcttgccattactccaaagcctagaaccttcacgtcatgaaggttctggaaggtttttcagattgcttaagatacgcagccattccatattcatctccaactacacaggggaacggagcagatagagctgcgactgggaagcgtcaccttcccgtccagagcgctttctttcagaccctgcctacctgcaggcagatggaccggagggttttctgcttcctttcaaccagataacttcctaagtggagatggcctgtaggtagcaaatgcaggattttgtttactttcatcatgtcatgtggtggtcagactgctcgctggtggcctcgctttagaaggttttcatcaagccccgccctttctctctcatagtcttaatgcgtctggaccactggggaaaatatttttcttttcaaaaagcagccccttcagtctgcgttcccagttcattttgcaggcgcattcgcccttcctagtttgcagcaattaaagataacggagtgtaaagtcattagacccagaattagagcagccagcagctggcccagtgtaaaaatgtcccaagtgtagcccctcccaccgcagagcctgtttctaacgtacctgccattcgtggaagtcgcctgggttttgtaaaggagaattttttggactcaagctgtcatcttcaagcacgccaacttcaggcagtgttttctactgcaaacctccacatcctggaatcaatcacactgacagggaaaggataaatgctcctttataagccaacatgtatccaaattaagcccccttacctttatccagaccctttcacaaacaagttctgagtttttagccaattgatcctctactttccttctttagtccctctcagggacgcctccatccccggctcccctaaaggtagaagatactcgagcatgctgccaggggagctggatggtgaaacacctgaagatctcatatcgcctctcaaaacactgtcggacttgctttctgctttatgatgtccgtagttgttctaatattaaatgctttgaatttctttattggtcaagttattttaacttgggcaaggcatacagtgataatcccctggcatgccacgattccagctcttcccacccccttgaaatcttacctcccaccgtggtggttttgtaaacccacagtcaattggatttgcccagaacctcccctacaggcgctcccagcccaggatccaggagacccgcaacatggtacagtaactcttcaccaaccgtcatcaataggttttcttagaaactacaactttaagcaaaatgaggtataatgaaactaattttggctgggcaaggtggctcaggcctgtaatccctgcactttgggagaccgaggcaggcgtatcacctgaggtcaggagctcaagaccagcctggccaacatggcaaaaccccatctctactaaaaatacaaaaattagccaggcctggtggcgtgtgcctgtaatcacaactactcgggaggctgaggcaggagaatcgcttgcagccaagaggcagaggttgcagtgagctgagatcgcaccactgcactccagcctgggcgacagagcgagacttcgtctcaaaaaaagaaatggcaactttaagcaaaatgatatataatgaaactaattttactataggctaatggatgtaaacaagagttaagttcccacggcatattgctggccataaaaacttcaccaaactttagaactttaaaccaaacacttctaatattaaacattaaatagacatgagttagttatacatacatttaagaaaaattactaaaaacaagataattacccaatttttggtgactctgagtgctggcagttgcagcgatggtgagttatatcacagaataaatgtttgcaaagcaaaaattgtcaggagcgcctccttccaccacgcaggtcaaacaccagaatgaacgggctcactgggcacttccgtacagcgtcatttactattgtgcatttgtatggttatgggaggcaatttttattttacaataattttttattcattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagacagtggccccagccgggaatcaatttttttctcaatgttataacaaaatgacattgaataaaacgatgctattcaaggacccactgtgtgtgaaatggtgcatgagggcattttctgggaaaaagcgtggttacctcgcatcagattctccaagggactacagcccccctgagaatttcatctctgccactagagtgtgttttgtaacccaagccatgtgccaccctggtgctgctgttgcccaggcaataatttatgtttcagagatactccagggacggcatcaccttctcctaccaagcacaactccctgcgccggctgaacgctagggtttcagctgatcggagggaaactgaatttccccaagagagggcttggtcctttctgaaaggaaaggctg

SEQ ID NO: 425508 - DNA, 5723 bp, Homo sapiens
gccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacaaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctacgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccagaaggttttgttttttttcaggtggggtctcgctctgtcacctagactagactggagtgcaatggcctgatctcggctcactgcaacctctgcctcccgagttcaagcaattctcctgcctcagcctcctgagtagctgggattacaggcgtccgctaccacaactggctaatttttacatttttagtagagacgggggatattgctatgttggccaggctggtctcaaacttctgacctcaaatgattgcctgcctcagcctcccaaagtgctgggattacaggtgtaagtcactgtacccagcccaaaagcagtttaaaaaaaaaaaagacaaaatatacaactcttgataaaacataaaggtacagtggtctatgaggaagagaaaaggtacctgaggatgcagaagtacctaccacatgggaaccgtttgtccacactcattccagagaaaaccgagtcctctcagttgcacacgtgtacgtatcagtgggaagtgcttgccattactccaaagcctagaaccttcacgtcatgaaggttctggaaggtttttcagattgcttaagatacgcagccattccatattcatctccaactacacaggggaacggagcagatagagctgcgactgggaagcgtcaccttcccgtccagagcgctttctttcagaccctgcctacctgcaggcagatggaccggagggttttctgcttcctttcaaccagataacttcctaagtggagatggccttccctctcagggacgcctccatccccggctcccctaaaggtagaagatactcgagcatgctgccaggggagctggatggtgaaacacctgaagatctcatatcgcctctcaaaacactgtcggacttgctttctgctttatgatgtccgtagttgttctaatattaaatgctttgaatttctttattggtcaagttattttaacttgggcaaggcatacagtgataatcccctggcatgccacgattccagctcttcccacccccttgaaatcttacctcccaccgtggtggttttgtaaacccacagtcaattggatttgcccagaacctcccctacaggcgctcccagcccaggatccaggagacccgcaacatggtacagtaactcttcaccaaccgtcatcaataggttttcttagaaactacaactttaagcaaaatgaggtataatgaaactaattttggctgggcaaggtggctcaggcctgtaatccctgcactttgggagaccgaggcaggcgtatcacctgaggtcaggagctcaagaccagcctggccaacatggcaaaaccccatctctactaaaaatacaaaaattagccaggcctggtggcgtgtgcctgtaatcacaactactcgggaggctgaggcaggagaatcgcttgcagccaagaggcagaggttgcagtgagctgagatcgcaccactgcactccagcctgggcgacagagcgagacttcgtctcaaaaaaagaaatggcaactttaagcaaaatgatatataatgaaactaattttactataggctaatggatgtaaacaagagttaagttcccacggcatattgctggccataaaaacttcaccaaactttagaactttaaaccaaacacttctaatattaaacattaaatagacatgagttagttatacatacatttaagaaaaattactaaaaacaagataattacccaatttttggtgactctgagtgctggcagttgcagcgatggtgagttatatcacagaataaatgtttgcaaagcaaaaattgtcaggagcgcctccttccaccacgcaggtcaaacaccagaatgaacgggctcactgggcacttccgtacagcgtcatttactattgtgcatttgtatggttatgggaggcaatttttattttacaataattttttattcattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagacagtggccccagccgggaatcaatttttttctcaatgttataacaaaatgacattgaataaaacgatgctattcaaggacccactgtgtgtgaaatggtgcatgagggcattttctgggaaaaagcgtggttacctcgcatcagattctccaagggactacagcccccctgagaatttcatctctgccactagagtgtgttttgtaacccaagccatgtgccaccctggtgctgctgttgcccaggcaataatttatgtttcagagatactccagggacggcatcaccttctcctaccaagcacaactccctgcgccggctgaacgctagggtttcagctgatcggagggaaactgaatttccccaagagagggcttggtcctttctgaaaggaaaggctg

SEQ ID NO: 425509 - DNA, 5050 bp, Homo sapiens
gccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacaaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctacgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccagaaggttttgttttttttcaggtggggtctcgctctgtcacctagactagactggagtgcaatggcctgatctcggctcactgcaacctctgcctcccgagttcaagcaattctcctgcctcagcctcctgagtagctgggattacaggcgtccgctaccacaactggctaatttttacatttttagtagagacgggggatattgctatgttggccaggctggtctcaaacttctgacctcaaatgattgcctgcctcagcctcccaaagtgctgggattacaggtgtaagtcactgtacccagcccaaaagcagtttaaaaaaaaaaaagacaaaatatacaactcttgataaaacataaaggtacagtggtctatgaggaagagaaaaggtacctgaggatgcagaagtacctaccacatgggaaccgtttgtccacactcattccagagaaaaccgagtcctctcagttgcacacgtgtacgtatcagtgggaagtgcttgccattactccaaagcctagaaccttcacgtcatgaaggttctggaaggtttttcagattgcttaagatacgcagccattccatattcatctccaactacacaggggaacggagcagatagagctgcgactgggaagcgtcaccttcccgtccagagcgctttctttcagaccctgcctacctgcaggcagatggaccggagggttttctgcttcctttcaaccagataacttcctaagtggagatggcctgtaggtagcaaatgcaggattttgtttactttcatcatgtcatgtggtggtcagactgctcgctggtggcctcgctttagaaggttttcatcaagccccgccctttctctctcatagtcttaatgcgtctggaccactggggaaaatatttttcttttcaaaaagcagccccttcagtctgcgttcccagttcattttgcaggcgcattcgcccttcctagtttgcagcaattaaagataacggagtgtaaagtcattagacccagaattagagcagccagcagctggcccagtgtaaaaatgtcccaagtgtagcccctcccaccgcagagcctgtttctaacgtacctgccattcgtggaagtcgcctgggttttgtaaaggagaattttttggactcaagctgtcatcttcaagcacgccaacttcaggcagtgttttctactgcaaacctccacatcctggaatcaatcacactgacagggaaaggataaatgctcctttataagccaacatgtatccaaattaagcccccttacctttatccagaccctttcacaaacaagttctgagtttttagccaattgatcctctactttccttctttagtccctctcagggacgcctccatccccggctcccctaaaggtagaagatactcgagcatgctgccaggggagctggatggtgaaacacctgaagatctcatatcgcctctcaaaacactgtcggacttgctttctgctttatgatgtccgtagttgttctaatattaaatgctttgaatttctttattggtcaagttattttaacttgggcaaggcatacagtgataatcccctggcatgccacgattccagctcttcccacccccttgaaatcttacctcccaccgtggtggttttgtaaacccacagtcaattggatttgcccagaacctcccctacaggcgctcccagcccaggatccaggagacccgcaacatggtacagtaactcttcaccaaccgtcatcaataggttttcttagaaactacaactttaagcaaaatgaggtataatgaaactaattttggctggtctcaaacttctgacctcggatgattgcctgcctcgccctcccaaagtgctgggattacaggtgtaagtcactgtacccagcccaaatgctgtttaaaaaa

SEQ ID NO: 425510 - DNA, 2924 bp, Homo sapiens
gccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacaaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctacgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactc

SEQ ID NO: 425511 - DNA, 1268 bp, Homo sapiens
aggacacagcgaggaaggcccgggcgcaacgtgtgcagtcagctccaaactgagcttccgagaaacactatttctaaagacacagaaagttcccagaatccctgttccaactacaacagggcctttttttttttgagacggggtctcactctatcacccaggatggagtaaatggcaactttaagcaaaatgatatataatgaaactaattttactataggctaatggatgtaaacaagagttaagttcccacggcatattgctggccataaaaacttcaccaaactttagaactttaaaccaaacacttctaatattaaacattaaatagacatgagttagttatacatacatttaagaaaaattactaaaaacaagataattacccaatttttggtgactctgagtgctggcagttgcagcgatggtgagttatatcacagaataaatgtttgcaaagcaaaaattgtcaggagcgcctccttccaccacgcaggtcaaacaccagaatgaacgggctcactgggcacttccgtacagcgtcatttactattgtgcatttgtatggttatgggaggcaatttttattttacaataattttttattcattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagacagtggccccagccgggaatcaatttttttctcaatgttataacaaaatgacattgaataaaacgatgctattcaaggacccactgtgtgtgaaatggtgcatgagggcattttctgggaaaaagcgtggttacctcgcatcagattctccaagggactacagcccccctgagaatttcatctctgccactagagtgtgttttgtaacccaagccatgtgccaccctggtgctgctgttgcccaggcaataatttatgtttcagagatactccagggacggcatcaccttctcctaccaagcacaactccctgcgccggctgaacgctagggtttcagctgatcggagggaaactgaatttccccaagagagggcttggtcctttctgaaaggaaaggctg

SEQ ID NO: 425512 - DNA, 754 bp, Homo sapiens
gacagatacgaatcgagctggtaccgaatctcgacatattgtgcatttgtatggttatgggaggcaatttttattttacaataattttttattcattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagacagtggccccagccgggaatcaatttttttctcaatgttataacaaaatgacattgaataaaacgatgctattcaaggacccactgtgtgtgaaatggtgcatgagggcattttctgggaaaaagcgtggttacctcgcatcagattctccaagggactacagcccccctgagaatttcatctctgccactagagtgtgttttgtaacccaagccatgtgccaccctggtgctgctgttgcccaggcaataatttatgtttcagagatactccagggacggcatcaccttctcctaccaagcacaactccctgcgccggctgaacgctagggtttcagctgatcggagggaaactgaatttccccaagagagggcttggtcctttctgaaaggaaaggctg

SEQ ID NO: 425513 - DNA, 4343 bp, Homo sapiens
gccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggagaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacaaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctacgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccagaaggttttgttttttttcaggtggggtctcgctctgtcacctagactagactggagttgcagtgagctgagatcgcaccactgcactccagcctgggcgacagagcgagacttcgtctcaaaaaaagaaatggcaactttaagcaaaatgatatataatgaaactaattttactataggctaatggatgtaaacaagagttaagttcccacggcatattgctggccataaaaacttcaccaaactttagaactttaaaccaaacacttctaatattaaacattaaatagacatgagttagttatacatacatttaagaaaaattactaaaaacaagataattacccaatttttggtgactctgagtgctggcagttgcagcgatggtgagttatatcacagaataaatgtttgcaaagcaaaaattgtcaggagcgcctccttccaccacgcaggtcaaacaccagaatgaacgggctcactgggcacttccgtacagcgtcatttactattgtgcatttgtatggttatgggaggcaatttttattttacaataattttttattcattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagacagtggccccagccgggaatcaatttttttctcaatgttataacaaaatgacattgaataaaacgatgctattcaaggacccactgtgtgtgaaatggtgcatgagggcattttctgggaaaaagcgtggttacctcgcatcagattctccaagggactacagcccccctgagaatttcatctctgccactagagtgtgttttgtaacccaagccatgtgccaccctggtgctgctgttgcccaggcaataatttatgtttcagagatactccagggacggcatcaccttctcctaccaagcacaactccctgcgccggctgaacgctagggtttcagctgatcggagggaaactgaatttccccaagagagggcttggtcctttctgaaaggaaaggctg

SEQ ID NO: 425514 - DNA, 6530 bp, Homo sapiens
gccgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggctgccgagaggcgggctcggcggccggaggtgggctccgggcgcggcgaacaggcctcgggggacccggcgctggcccagggtctcctggagggcgcggggaggcccccggcggcgcgggcgactcgggccgaggggcaggacgtagcgagccgctcacgttctcctctggcccgcgagggcgccgggggcggggagcagctggtggaccagctcatccgcgacctgaatgaaatgaatgatgtgcctttctttgatatccaactgccttacgaattggcaatcaatatatttcagtatctggacaggaaagaactaggaagatgtgcacaggtgagcaagacgtggaaggtgattgcagaggatgaggtgctgtggtacaggctgtgccagcaggaagggcaccttccggatagcagcatctctgactattcttgctggaagctcatcttccaagagtgccgagccaaggaacacatgttacaaaccaactggaagaatcgcaaaggtgccgtgagcgagctggagcatgttcctgacacagttttgtgtgatgtgcattctcacgatggtgtggtcattgcgggatatacatcaggggatgtgagagtgtgggacacccgcacctgggactacgtagcccccttcctggaatcagaggacgaggaggatgagcctggaatgcagccaaatgtctcctttgtgaggataaacagctcgttggcagtagcagcttatgaggatgggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaagatcctggtgtatagcctggaagcaggacgccgcctcttgaagctgggtaacgttctccgtgacttcacgtgtgtcaacctcagcgacagccctcccaacctcatggtcagtggcaacatggacgggagggtgaggatccacgacctccgcagtggtaacatcgccctgtcgctctccgcccatcagctcagggtctctgctgtgcagatggatgactggaagatcgtcagtggaggcgaggaaggcctggtgtccgtgtgggattatcggatgaaccagaagctgtgggaggtgtattccgggcacccggtgcagcacatctcattcagcagccacagcctcatcacggccaacgtgccttaccagacggtaatgcgaaacgccgacctggacagcttcactactcacaggagacaccgggggctgatccgcgcctacgagtttgcggtggaccagctggccttccagagccctctccctgtctgccgttcatcctgtgacgccatggccactcactactacgacctcgcactggcctttccctataaccatgtttagggatgtgcctcagttgggagcaaggagaaaaatgggaagaaccagttttatccatcttaaaacgccaggcacctcttcacaggtggtaaacatttaggggaagaaagcagcccagggtgccatgcctgacagcacgcatctccctgacccctgcacttcccccagcgcctggggcaagctggcgtgtgccagggctcgagtcccacgtgctgccaactcaaacatagcctccttccccacccagctggccaccctggcctcagctccctcaggacgcctcagggatctcgctgcgcggtcctatacggtccctgcttagccagcttctgtgtgtccgccctcccagctccagccctgcaggccgtcttttccgtctccagccccttacctcttttcctccgagggcctttggatgtgcttgttcctggcctccaaggcaataacctccatgtccttttccctgtatttacttggggtgctcttctgtgacacttgccaccaccaccttccagtagcaagctggtagagctgtactttttcttcacagcttttaccatggtttataattatatacttatacagtttagtcatcaatgactattttgcttactattgtgtctatgatatgtgatacaaagcaaatattttctaaatattcattgactaaacagccatcaagatgaaacaggacaggagagaactgttcagtgtgatacagagctgccatttccaaagtattctggaagcaagccattgccttactcttgattttcaacagttctaaacagcaacagcatccacctaatataccttcagaatatcaaagcgaaaactgatagaactacaaagagaaataaaatccattctcacggcaggcaaatcagtgagaaaaatgtaaagatctggaggatttacttagtatcgctaacaagctggatccagtagatgcgtatggaatttcaaatacacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccagaaggttttgttttttttcaggtggggtctcgctctgtcacctagactagactggagtgcaatggcctgatctcggctcactgcaacctctgcctcccgagttcaagcaattctcctgcctcagcctcctgagtagctgggattacaggcgtccgctaccacaactggctaatttttacatttttagtagagacgggggatattgctatgttggccaggctggtctcaaacttctgacctcaaatgattgcctgcctcagcctcccaaagtgctgggattacaggtgtaagtcactgtacccagcccaaaagcagtttaaaaaaaaaaaagacaaaatatacaactcttgataaaacataaaggtacagtggtctatgaggaagagaaaaggtacctgaggatgcagaagtacctaccacatgggaaccgtttgtccacactcattccagagaaaaccgagtcctctcagttgcacacgtgtacgtatcagtgggaagtgcttgccattactccaaagcctagaaccttcacgtcatgaaggttctggaaggtttttcagattgcttaagatacgcagccattccatattcatctccaactacacaggggaacggagcagatagagctgcgactgggaagcgtcaccttcccgtccagagcgctttctttcagaccctgcctacctgcaggcagatggaccggagggttttctgcttcctttcaaccagataacttcctaagtggagatggcctgtaggtagcaaatgcaggattttgtttactttcatcatgtcatgtggtggtcagactgctcgctggtggcctcgctttagaaggttttcatcaagccccgccctttctctctcatagtcttaatgcgtctggaccactggggaaaatatttttcttttcaaaaagcagccccttcagtctgcgttcccagttcattttgcaggcgcattcgcccttcctagtttgcagcaattaaagataacggagtgtaaagtcattagacccagaattagagcagccagcagctggcccagtgtaaaaatgtcccaagtgtagcccctcccaccgcagagcctgtttctaacgtacctgccattcgtggaagtcgcctgggttttgtaaaggagaattttttggactcaagctgtcatcttcaagcacgccaacttcaggcagtgttttctactgcaaacctccacatcctggaatcaatcacactgacagggaaaggataaatgctcctttataagccaacatgtatccaaattaagcccccttacctttatccagaccctttcacaaacaagttctgagtttttagccaattgatcctctactttccttctttagtccctctcagggacgcctccatccccggctcccctaaaggtagaagatactcgagcatgctgccaggggagctggatggtgaaacacctgaagatctcatatcgcctctcaaaacactgtcggacttgctttctgctttatgatgtccgtagttgttctaatattaaatgctttgaatttctttattggtcaagttattttaacttgggcaaggcatacagtgataatcccctggcatgccacgattccagctcttcccacccccttgaaatcttacctcccaccgtggtggttttgtaaacccacagtcaattggatttgcccagaacctcccctacaggcgctcccagcccaggatccaggagacccgcaacatggtacagtaactcttcaccaaccgtcatcaataggttttcttagaaactacaactttaagcaaaatgaggtataatgaaactaattttggctgggcaaggtggctcaggcctgtaatccctgcactttgggagaccgaggcaggcgtatcacctgaggtcaggagctcaagaccagcctggccaacatggcaaaaccccatctctactaaaaatacaaaaattagccaggcctggtggcgtgtgcctgtaatcacaactactcgggaggctgaggcaggagaatcgcttgcagccaagaggcagaggttgcagtgagctgagatcgcaccactgcactccagcctgggcgacagagcgagacttcgtctcaaaaaaagaaatggcaactttaagcaaaatgatatataatgaaactaattttactataggctaatggatgtaaacaagagttaagttcccacggcatattgctggccataaaaacttcaccaaactttagaactttaaaccaaacacttctaatattaaacattaaatagacatgagttagttatacatacatttaagaaaaattactaaaaacaagataattacccaatttttggtgactctgagtgctggcagttgcagcgatggtgagttatatcacagaataaatgtttgcaaagcaaaaattgtcaggagcgcctccttccaccacgcaggtcaaacaccagaatgaacgggctcactgggcacttccgtacagcgtcatttactattgtgcatttgtatggttatgggaggcaatttttattttacaataattttttattcattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagacagtggccccagccgggaatcaatttttttctcaatgttataacaaaatgacattgaataaaacgatgctattcaaggacccactgtgtgtgaaatggtgcatgagggcattttctgggaaaaagcgtggttacctcgcatcagattctccaagggactacagcccccctgagaatttcatctctgccactagagtgtgttttgtaacccaagccatgtgccaccctggtgctgctgttgcccaggcaataatttatgtttcagagatactccagggacggcatcaccttctcctaccaagcacaactccctgcgccggctgaacgctagggtttcagctgatcggagggaaactgaatttccccaagagagggcttggtcctttctgaaaggaaaggctg

SEQ ID NO: 425515 - DNA, 1683 bp, Homo sapiens
gagccaaagggaagtgctgcgaggtttacaaccagctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtgcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatca

SEQ ID NO: 425516 - DNA, 1832 bp, Homo sapiens
gagccaaagggaagtgctgcgaggtttacaaccagctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatca

SEQ ID NO: 425517 - DNA, 1327 bp, Homo sapiens
gagccaaagggaagtgctgcgaggtttacaaccagctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggcccgaatgcagtggtgccaggacaggatagctcactgtagccttggcctcccgggatcaagtgatcctcccaccttcgtctccc

SEQ ID NO: 425518 - DNA, 8617 bp, Homo sapiens
ttcacgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttccttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaagtggcagtggcagagaatccaaactcaacaagtgctcctgaaagaaatgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcctacggaggcctcgagcagaaagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggagtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcacta

SEQ ID NO: 425519 - DNA, 523 bp, Homo sapiens
agcggggaacaatcacttagagtgacagagccatgtccagccttctctgttcagcatgaagagttattacagacatattctatacagtgtaagcagttttacacttacagggattacactgtatttctttgacttcagttgtctttgtttctcttcagaagagccacctggcagcaaaggttctgtcactctaagtgatcttccagggtttttaggtgatctggcctctgaagaagatagtattgaaaaagataaagaagaaggtaatgtatgtgggattgctatgagttgataaaacctgaccctcgctctgctataaatctgggattttgtgccattgctcacaggcttgctggatttttcttctcttgaggtaacaagatgggtggtttagtctgggacctatgccaggtaaagtgattgttccccgctagcggggaacaatcactttgggcatttttaagtgccagtctgggccttgaacgtccacatctgggacatcaatgtccactttggggccctt

SEQ ID NO: 425520 - DNA, 8554 bp, Homo sapiens
ttcacgacgggggaggtgctgtacgtccaagatggcggcgccctgtaggctggagggactgtgaggtaaacagctgagggggaggagacggtggtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttccttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaagtggcagtggcagagaatccaaactcaacaagtgctcctgaaagaaatgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcctacggaggcctcgagcagaaagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggagtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcacta

SEQ ID NO: 425521 - DNA, 9265 bp, Homo sapiens
ttcacgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagtatggtgtcaactagtgtgcctgctctctcctctgctttctggtgaagctgaccctttgggtcagatttagtatgtggttgggaaaatttcacactgctcatttcaggagtcacttttaaggatccatgatattagcaaagaaagttactgttgcctcttagattcatcttgaagtcttgatttacaaaatgcaacttgtttcttgatacgcttttaataagatgcctttttctagatgaaaaagctaaatttaagctgaacactggccatggatataaacctcgtggatgacttagcattcctttgccactgctgatgtactttattaacttcccaggctactctttggagcccatctatggtttgtggtatgaccactcctccaacttctcctggaaatgtcccacctgatctgtcacacccttacagtaaagtctttggtacaactggtatgtatgtcttaggttggatttgattagttggttttggcctgcctttaatggcaggaggagctctcttttagatctaagggaccacttgctgttgtaaacttgtttttgacacttattgcaaatccctggggctttcagaatgtgtaaagtgaacctaaaaacaaaaaagagagagactgatctagatccccagaaagttaactctagcagctttatttatagtaatagttataggctgaaaaaaaatcggcagtttttctaatagttgggctcagtgttcatatatgttctgcccttgtctctaagcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttccttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaagtggcagtggcagagaatccaaactcaacaagtgctcctgaaagaaatgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcctacggaggcctcgagcagaaagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggagtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcacta

SEQ ID NO: 425522 - DNA, 8080 bp, Homo sapiens
ggttggaagcattatgtctactcctcaggcacctctttgccttcttgactaaaaggtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttccttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaagtggcagtggcagagaatccaaactcaacaagtgctcctgaaagaaatgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcctacggaggcctcgagcagaaagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggagtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcacta

SEQ ID NO: 425523 - DNA, 4500 bp, Homo sapiens
ttcacgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttaaaaaaaaaaaaaaaaaaaaaaaaaaaaaaaaaaaacaaagggggcaaaacaacacaaaaaaaacaaacaaaaaacaatggtgggggccaccgacccccggagaaatgttaaaaaccaaaggggggccgggcggcgccacaaaaagaaaagagcaaaaggaagcaaacgggttacacaggaaccacgtgggaaaaacaaaagggcgggagtcacaacacaaataaaaagcgacggggggaaccacagcggagctatgacgaacacaacacgagagagggagatctcgaggagcacaaaagggggggaacaaaacagaggaggctcacacaagaggggggagagaataaaaaaaaaaccggcagggagtgtaggggcggggaacagaacacccgaaaagaagagagagcacaagacacacaaacgcaggacacaagacaagacagacagagcaacagagacacaaatcggaggaagacgaaggacacacgaacacagacacaacaa

SEQ ID NO: 425524 - DNA, 1552 bp, Homo sapiens
ttcacgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggtgcgatccagctcgtctgctatccctctgcccaggcacagtgactcacttg

SEQ ID NO: 425525 - DNA, 8588 bp, Homo sapiens
ttcacgacgggggaggtgctgtacgtccaagatggcggcgccctgtaggctggagggactgtgagtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttccttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaagtggcagtggcagagaatccaaactcaacaagtgctcctgaaagaaatgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcctacggaggcctcgagcagaaagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggagtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcacta

SEQ ID NO: 425526 - DNA, 8857 bp, Homo sapiens
ggggctcagtgttctgttgagtctgtttgaatgttatcccttcagtaatccttagggatagggaaatgagtacgtgagtcaacttgtgatttgtgattctctcagtgtttagagcctcttcatgtactgtacaatgccgatcctggtgccagtgcctgacagacgtttcctgtttgaccttttctcctgcagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagtatggtgtcaactagtgtgcctgctctctcctctgctttctggtgaagctgaccctttgggtcagatttagtatgtggttgggaaaatttcacactgctcatttcaggagtcacttttaaggatccatgatattagcaaagaaagttactgttgcctcttagattcatcttgaagtcttgatttacaaaatgcaacttgtttcttgatacgcttttaataagatgcctttttctagatgaaaaagctaaatttaagctgaacactggccatggatataaacctcgtggatgacttagcattcctttgccactgctgatgtactttattaacttcccaggctactctttggagcccatctatggtttgtggtatgaccactcctccaacttctcctggaaatgtcccacctgatctgtcacacccttacagtaaagtctttggtacaactggtatgtatgtcttaggttggatttgattagttggttttggcctgcctttaatggcaggaggagctctcttttagatctaagggaccacttgctgttgtaaacttgtttttgacacttattgcaaatccctggggctttcagaatgtgtaaagtgaacctaaaaacaaaaaagagagagactgatctagatccccagaaagttaactctagcagctttatttatagtaatagttataggctgaaaaaaaatcggcagtttttctaatagttgggctcagtgttcatatatgttctgcccttgtctctaagcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttccttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaagtggcagtggcagagaatccaaactcaacaagtgctcctgaaagaaatgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcctacggaggcctcgagcagaaagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggagtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcacta

SEQ ID NO: 425527 - DNA, 7205 bp, Homo sapiens
agcggggaacaatcacttagagtgacagagccatgtccagccttctctgttcagcatgaagagttattacagacatattctatacagtgtaagcagttttacacttacagggattacactgtatttctttgacttcagttgtctttgtttctcttcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttccttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaagtggcagtggcagagaatccaaactcaacaagtgctcctgaaagaaatgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcctacggaggcctcgagcagaaagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggagtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcacta

SEQ ID NO: 425528 - DNA, 1498 bp, Homo sapiens
ttcacgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactcttggagccatctatggtcgggtatgaccatcctcagctcttcggaatgtccaacgatcgcaccctacagcaaagctggcaaacggggaaggatcctgggaccagaactctctctcaagccactggacgagacagggcagtactcctcaggcagccccaggaggcaaaggccgaaccgtacagaaccaatcgagacagacaaaccggcactcgccaggaggaccgg

SEQ ID NO: 425529 - DNA, 644 bp, Homo sapiens
aaataatgttttctggtactaaaactggcatggtaagtgcatacttagagtaaggactttaaatcacgggccagttagatctacctagttagtggtttggtacgcaagaagtacccatgggtgtattacacaaatgcaggaataccatatctagaaatacacctttgatattcatagtgtacctgagaatggtttcacgcataattttaggtaaactgccttagtcactctggttttacggatctttgcccacagttcctcgttcataacttctatagcccttgttatagtcatgttgtgtgtgttaggccacaggaaactcacttcacttctgcccttttaccttcactaagacgggactcttgatcttcccctacctttctgtgagtcctaagacccccatttcagagagggttctgtcctatactctgcggaaaggaatgctgtcatcttgaagcctccctacaaaaccaagaggactgagtttggatatgtgaacgtatggaggttcctggaggatggcacacccaggcaaggcattaaagctttgcaccctttcccccataccttgtcctatgcatctcttcaactgagtcctttgtaatatctttataataaagcaaatgtggccaggcgtggtggct

SEQ ID NO: 425530 - DNA, 5453 bp, Homo sapiens
tggcagtttggtctggagcagctgaaaccggtttgagcgtggctgcttcctgccgctcgacgccgcggcaggccgcctgggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425531 - DNA, 2310 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttaggtatgggcattaactgcatctgtttgaggcatatgcataaagttactaatatgctgcacaatggcttagtgggatttaataaatttttattctaaagttaaggtcaatgcattgtcagtgctacaaatttcactgagcatttcatggatctttcaaaacaacagtttttaattgcctcttaaaataaactttattagaaatatttacctagatatttttgttttcttgggttagattagtttattatgaaatattcactttcatttggaatggttaggaagtttataagataccattcttcttgactg

SEQ ID NO: 425532 - DNA, 1089 bp, Homo sapiens
tatatgtgatggattttagtatatatatatactaagtatatatatatatatactaagtatatttgttggacagatgatttattggtgataccttaattcatttcctgtagaagtgccttcaacagagtgacattgatcatttgatagacattaaaacctaatacaacagatttgcttgtgggggaaacatggtagctcagagtgcttaagtattatggtttatagctaatcagacaattttttcatgacatttggtgtgtctgctgtttttaatcagatgtttaaaagtcttcgaaaagattagaaacttacagaaataaattttatatagtactttcatattgatttctagtcacgtagtatggataagtatcaaagaaaatgtatagacagcataacaggaagtaggggagatgactgacttctggttctatcctcagctgtcttcagcgctacagctttctgccagctgcattttccttccaggtattctacactgcaataaaaatgaaagccagaatataagggctgggaggtggtgttaggttagaagggctgtcctgcatgggctcagtatggctactaacagttattctcattgttgagtaaatagagttgctaggcctgtctagtgtaagcattcagtaataatttagggcttacttttctcttaattttctttattctttctttttctttctttcttttttttttttttttagaaatttgatgctgatccagttgaattatttgaaattccagtaaaagaattaacatttgaccaactccagttgttaaagctcactcatgtgactgcactgaaatctaaggatcggaaaggtatgtaccaatatggaaacactgttttccttttgtagttagcattaataggatttttaaaatcgattttagcacatacttgatacttggtcatttttatgagtataatactgggccttctaaatgtaattttatagttcggaaatgaatttgcatttgttttctactaaatatatatcatgtgtatagtaaccattgcattgcttttcttagcttgatgatcaaagtgttaatacttatcaatctttc

SEQ ID NO: 425533 - DNA, 342 bp, Homo sapiens
aagattctccaataagacacagtagagtctctagccaaaagtgattgaggtcccttcatctctgctgtttgttcaatgtaaattagccatcatcctccctgtttgtttttctcatcttcccacatgggctcaacaccatccttaaaaagtgagtagtcacagccagacattaaattactagacaactggatatggttgtacagagcccaaaagtcaacaggatcaaacttagagatcagcggcaggtttgcttgtcaagttttgcttttatcttttttaaaaaaaccagagtgcccatctgttctgtagaggatgtttaatatagtgttctgggttagcaac

SEQ ID NO: 425534 - DNA, 5793 bp, Homo sapiens
agggtggggttttacagcttttctcattgagttgaaatttctgttaggagaaggggttgtgctagcgtttattcttttggtagttcctcacagctctgtacatacaggtaagttcacgctgttcgtaaagcttttaactggcagtagtgaatagttgggatatgaggagaattacatttgagacaagttcagaatatgcactacataagaataagcattttaattgtgccaagacctttggtttgaaaatcaagaaggagttatcgttgtccagcaacctgtgagtcttgtacattggttagtgtagaagttaatcccagtgcctctagagcacctttctgaagagttttctttttcttctttttaacataatggacaatcaacgaagtatgtaagaaccattactgtttgctagcctcctttaaagggaattctttattgagggctacaataaatatgcttattcaccttgggctgcttttaagctgtagatttaatattataaacgatctttaaggtgggtaatttctcagttgttcactgggtatgcatcaagagttttaactaaattttctattttccttaaattctagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425535 - DNA, 5570 bp, Homo sapiens
tggcagtttggtctggagcagctgaaaccggtttgagcgtggctgcttcctgccgctcgacgccgcggcaggccgcctgggggagcgctggcgaggcacggacggcgggcgcccggtacctctgcccgcggtcctcgctctcgggcggggcggcggcgacgcggacctgcggactagcgaacccggaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425536 - DNA, 5075 bp, Homo sapiens
aaacggggtttcactatgttagccagactagtatcaaactcctgaccttgtgatctgcctgcgtcagcatcccaaagtgctgggattacagacgtgagccactgaccccggccgaaaatactgaagtttttatgaaaaaaaaaatatatatatacacatttcatatataggagatatgtgtgtgtgtgtctgtgtgtgtgtgtgtgtgtgtatatgtatgtatgtaatgtagaagtttaaaaattaagattattttaaatctcattttttcaggaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425537 - DNA, 4810 bp, Homo sapiens
tatatgtgatggattttagtatatatatatactaagtatatatatatatatactaagtatatttgttggacagatgatttattggtgataccttaattcatttcctgtagaagtgccttcaacagagtgacattgatcatttgatagacattaaaacctaatacaacagatttgcttgtgggggaaacatggtagctcagagtgcttaagtattatggtttatagctaatcagacaattttttcatgacatttggtgtgtctgctgtttttaatcagatgtttaaaagtcttcgaaaagattagaaacttacagaaataaattttatatagtactttcatattgatttctagtcacgtagtatggataagtatcaaagaaaatgtatagacagcataacaggaagtaggggagatgactgacttctggttctatcctcagctgtcttcagcgctacagctttctgccagctgcattttccttccaggtattctacactgcaataaaaatgaaagccagaatataagggctgggaggtggtgttaggttagaagggctgtcctgcatgggctcagtatggctactaacagttattctcattgttgagtaaatagagttgctaggcctgtctagtgtaagcattcagtaataatttagggcttacttttctcttaattttctttattctttctttttctttctttcttttttttttttttttagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425538 - DNA, 6881 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaatctgtggttcaggaggaaaattccttttcagaaaatcagccatttccttctcttaagatgggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425539 - DNA, 4151 bp, Homo sapiens
gcaaaattctagagttttagcttttattttaactttattaatgcaaaagtgtattgatgatatagttaatagttacttgctttttgtatgagagtctctatgtctgaattatgacctgtgtcatcactaaatagctttgtgatcttgggcagatcacttaatcttttcaggtttcatcatctataaaatagtagttggactagatactgtcaggggttttttcatcatagcttgccagaataaaaacagagttgctagcactgattttaggatgtgcagtgacttttattttgctttctctttcactaggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425540 - DNA, 3699 bp, Homo sapiens
ttagatatgtctttaataattaatagaaactctttgttttaatacagtcagatatttattagagtcaccatattttttatcgtgttgaaaaaattctttcctactgtgatgtcataaagattctctgatactgccttacatagttgcctggctgtcacattcaggcacaggaggccatcttttctctgctgatgggtagtgccagtgtcaggtcaccagaggctctttcagagttctccactctggacgtgtctgacgttattgagcagctttagagtagttcccacgctggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425541 - DNA, 7308 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcacagaaaggaagggaggaagattgagtggccgcggtttacaacgtcgggactggggccctggcgtgccgcgtagatcgctttgaggacggccgcgtgtggcgggtgg

SEQ ID NO: 425542 - DNA, 3804 bp, Homo sapiens
cttatctcgatctttagtgactttgaagtcagagcagtcagttttttatagatttccatttgttaaaaaaaggcaagttggagggcaaatactttaagctagatcacaagtaaactagacatttcattttctgattcagctgctttatgttgagctccattgcatcgggggtacaaaagggcaatgctgctattctggattattggaaagactgggaagaagagaaattttaaaaaagagaatggatactttcatctttaaaacaaaacaaaaactctgatgtggatgttccaggcattctgtaaatgaattcttatgaaaaggttgagtcaggcaggtcttaggtaaaccataaaattacagtattttatgtgttttgtatttgtttcatcataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425543 - DNA, 3556 bp, Homo sapiens
aagattctccaataagacacagtagagtctctagccaaaagtgattgaggtcccttcatctctgctgtttgttcaatgtaaattagccatcatcctccctgtttgtttttctcatcttcccacatgggctcaacaccatccttaaaaagatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425544 - DNA, 7224 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaatgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaatcctagtttcctaactcagattgtttcacgataaacacagttttgtatggcatgcttggccataatgtctgg

SEQ ID NO: 425545 - DNA, 2510 bp, Homo sapiens
cgaattcgtgctcgatacccaatcagtttacacaaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425546 - DNA, 5181 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcatt

SEQ ID NO: 425547 - DNA, 1948 bp, Homo sapiens
agctgcctctagaggatccaccaaggtaagtcgagaccgactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425548 - DNA, 4297 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcatt

SEQ ID NO: 425549 - DNA, 3894 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggtatttgtttttcatgaaaaattttcatggaatttagaagtatagatttcatcttacgaaattataaataaaattaaacttagttaagttaaaaaaaaaa

SEQ ID NO: 425550 - DNA, 3550 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagtaagttgaatatttgagtaggattagcatttggtgtagcttatgttcggtagagttacactggttttctcagcaaaggtcaaatgatgtttttattatttaccaagggaatttagtgtaatttggtaattggggttagagaccaaccttaagattctggtcagttttttaatatatctactgaattgataaggaggaagacattaaaagtagaaaggcaggaaggaaagcttggtgcagaaagctttgggagcatcagtgtgtgtgtctgtgtcatggtccttacttttgacgtgttgccctctctgagtctgagtttccgcatctataaaatgcaaagatttggacaacattatcccaagtctagaaaagtgtgactaaactcaaggaatattagttaacttggacctcaacgaaagatgctctatcttctcaacagacattagattgtagcctggaatagttgtcttccccttctacttttgtaagtttatttaattaccagtgcgatagctcatgccacagattttctactgtaaattttaatccctccccattttattttaaagtgatgctgtggagat

SEQ ID NO: 425551 - DNA, 2643 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagtgagtagttactgcagtgaggggattgagaaagagtgcagggacaagcttattttaacgttggttttgattttcattttaatctaatttgtgtaaggctaactttttagaggtatgctcttctgtacagttaagcttaaaaaacttagagttgtcatcttcaagtactattaagaatataattaagagatacagcagtattgatgttccaatcaagaccagatgtctttgatgcctgtatgc

SEQ ID NO: 425552 - DNA, 505 bp, Homo sapiens
caggtgtgagccaccacgcctggccttaataatgttcttgatgtgaaacttattagtagctactgtttgactttctagaaaatattgattaataaccctttagagtactgataggcatttagtgtttgtctgttaaaattggaagctgtcttgaaagcagagactgtggttttatcccttttgtactcttgggttcttgttactggctcaatgagtagttgaacagatgaagaaaacttcatccgtatgccttcccccttttctctggctttggttctagaaaggtgagtcgagttaattggcaggtgttagtgagtggtaggtacctgggcccaaacctatatctagtgaggctctttcatctctgctaaagggggcagcatatctggttgaactaatgcaaacttccctgcttatcccactgtgactgattgttctgtttctctgtgactgattgttctgtttctttaggagaagtttttgcgatatgtggaagctgtgatgc

SEQ ID NO: 425553 - DNA, 540 bp, Homo sapiens
atcccagtgcctctagagcacctttctgaagagttttctttttcttctttttaacataatggacaatcaacgaagtatgtaagaaccattactgtttgctagcctcctttaaagggaattctttattgagggctacaataaatatgcttattcaccttgggctgcttttaagctgtagatttaatattataaacgatctttaaggtgggtaatttctcagttgttcactgggtatgcatcaagagttttaactaaattttctattttccttaaattctagaaagcgaaattattattgacgatggacaatttggaatccacagtaagtgagactgacttacttaaatgtttactgaaatgattgagattgttactttacatttcactggagttatatagcacaggaaaatagaacatacagtcatgtgctgcataacgatattttggtcaaagacaggccacacgtgcagcagcagtctcatatgattataatgaagctgaaaaattccctgtacttacacaaacaacaatgaaatcgtc

SEQ ID NO: 425554 - DNA, 7202 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425555 - DNA, 5647 bp, Homo sapiens
tggcagtttggtctggagcagctgaaaccggtttgagcgtggctgcttcctgccgctcgacgccgcggcaggccgcctgggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425556 - DNA, 7148 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425557 - DNA, 4392 bp, Homo sapiens
agtcacagccatagtcatattttggggatgtcaaaactggcctcagaatacagaataagtaccatttcccattgttgaaagtacactttgcttctttattacatttgtttctttatcttctctatagtctatgttaactgtatttcttcttttcaggctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425558 - DNA, 3903 bp, Homo sapiens
ccctcgaaacccagtccctcgaacccagtattgaaataaaatggagtactgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggca

SEQ ID NO: 425559 - DNA, 7278 bp, Homo sapiens
agtttgatatataaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattgggaggctgaggtgggtggatcacgaggttaggagttcgagactagcctggccaacatggtgaagccccatctctactaaaaatacaaaaattacctgggtgtggtggcacgtgcctttaattccagctactcaggaggccgaggcaggggaatcacttgaacccaggaggcaagggtgcagtgagccgagattgtgccattgcactctagcctgggtgacagagtgagactctgtctaaaaaaaaaaaagagtatgtgtaatataatgcctagaaaagggctcaaagattatatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccctgtggaaacttcaggaaggatgaatccgtctttgtgctccacggctcgtaccttgatcaggctgtgcatcacagtaattccgttctaggtaggcagagttgatctttgtctcatctgccaggctgcgggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaatcctagtttcctaactcagattgtttcacgataaacacagttttgtatggcatgcttggccataatgtctgg

SEQ ID NO: 425560 - DNA, 2344 bp, Homo sapiens
cacaccaggttcccacgactgtctaccactcagttatttttaacagctgttaaatatctcagactcaccccagcctgaagctaggtttctgacaataacatgcatttaactctaagtttacttctgttctccctacacttccccacgtatattattcgagttaatttttgtcttgtttccaatttatttcaaaggatgcgaagtacaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaaatcgaaaagtatcctccttgcacacctcccgagttcagaggcagatggtggtctccgttcacgacttacccgagaagagctttgtgcccctgctggacagcaaatacgtcctctgtgtgtgggatatttggcagccttcagggccacagaaggttctgatatgtgagtcccaggtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatttctttggtattcccagtaaatacatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacacgtctaaattaaaaggaattactccaccgaaa

SEQ ID NO: 425561 - DNA, 2317 bp, Homo sapiens
  misc_feature (1213)..(1213): n is a, c, g, or t
  misc_feature (1302)..(1302): n is a, c, g, or t
  misc_feature (2219)..(2219): n is a, c, g, or t
tttaaataaactcccagtagtgaggagctgtggaacttctgattcagaccatgagtcagaggaaccaaattctcacccgggagaccagccctttcctcagtcgagccatcagtgcttcatctgggtcctctcacttagacaccctgtaatttattcttaatttctgagatggttttgtctttttcttcagtttctttcctgagttcaatcccagttctcatttcatttcttgcttttttgggtctaattctgttcttgatttctgattcccggtgttttttcttgcttgttgttttgatatgtttccagatgccctttgaggagatgtgattccatttggaacgttgagttttgtgtcttctgccttttgcttgtttttaggagggataattttcatcagctgaaatgctttcatttacattttttctgttttcttcttatagtagctttctatggagtttggcgtttttctacttgtagacattctgtaggtgtatattttaggtcagtgagctttgctttattgattggcgacaggtatcttttcagtgggcattgtgcctcgaggtggtaggtggggtgggtttgcctttcctttggttttgcaaatgcctggattttgctcttgctggcagttgtgaggtgtgtgcggaggtctcccccatttcctgttcacgtcccccttcccatcggccgtgctgctccgacctcctctgcctcccagctccttcccctcagttgtttgagtggcccccaggatttggcctcgcagagactttctctgtctgagttttctttcgggctgtgtggcatgctctgtttggatggtgggctttagctttcttcctgccttccagactggagagcaggggctggggcccgtgtgtcctaggaatctgaaagtcgtggtcctgtgtcagttgtgtgtgtcagtcgtgtgtggtccatgttggttttggggtgttttgggaagatgtgtggagagagttggatctgtgagacccagaagcacctcgtgtttgtccctgtgtgatgcgaactgcatttcttcaacttactacttacacgtggatgctgtgggcttttgaactccagatggaatccttacctcagtaaaccaccgaagccctcttcaagcagtagaacctatctcaacgtccgtccacaaaaagcagagctttgtgctttcacccttttctactcaagaaggtangtgattcttcactttcttaaaatccttcatcaatggttgtgaaatatggtttccttatttaaagccatttctttctttttgtttctgtnttcatcagaaatgtcaggtttgtccttccacatcgcttccttggatgagagtggggttctcaatgtatgggtgagtagtggcccaggccgggcacatgcggggcctgagtgaggtggtctgggtggaggtggcgcctgaatggcgcagggggcgggacccagttagctgtggtgggaaacggagagcaagactgggcttcttggtcctgagcagaagggatgcagaaggccacacatggcaggtttggggccctttcgtgacagtgaaatagggactctcacacagggctttgggaacgcggaatgaaagtgagaagggaacaaaatgttagggctgaggtgatgctggattggcttgtcctggaggatgcgccaagactgttgattaagtcaccaagtgaagagaacacgaggagatcaaagcaaaggagtcaacttgtagagtgttagttctgaggctaaagatcagtctctttttctggagcagttatgttttagtacctaaatagcactccatcttaattagagctatgctttgcttaggttgtttcataattataaaatgtatcaatattcattttcaatattctgtttttaggtggttgttgaattaccaaaggcagacatcgcaggttcaataagtgatttaggtaactattaagtaaaaaaattaattttagtgttttctaaaatgaatcgagattaaaagtactgataactgcggtcaggtgcagtggctcacacctgctgggagcctcagcacgttgggaggctgaggaaggaggattgcttgagcccaggagttccagaccagcctggacaacatagcaagaccccgtctctacaaaaaaattcaaaaattggctgggcgtggtggcacacacctgtagtcccaactgcttgggaggctaaggtgngaggattgcttgagcctaggagtttgaggctgcagtgagccgtgatcatgccactacactccagcctgggtgatggaatgagaccttgtctctctgtt

SEQ ID NO: 425562 - DNA, 426 bp, Homo sapiens
agggatgctgtgtattgatttgcatttgatgttatttcctaacacagatatttaagcaatgaaaaatgattccaggcaactataactagattttgatttagcttctattgaaaggtgcattgattttggttcatctctttttaggtctgatgcctggagggagggtcaagctggtacatagtgctctgatccagttgggtgacaggtaagatgtgagggaaaatgcttcactatctcacaaagacctagaaggaaaataacattggggaattgcatatacggtaaatggtgagcttttgcgatgaagaagtccattttctcacattgtttttttactgttttgttagtctattatttttatttttttatttttttgagacggagtttcactcttgttgccccggctggagtgcagtggtgcaatct

SEQ ID NO: 425563 - DNA, 2413 bp, Homo sapiens
  misc_feature (2)..(2): n is a, c, g, or t
  misc_feature (5)..(5): n is a, c, g, or t
  misc_feature (1076)..(1076): n is a, c, g, or t
  misc_feature (1165)..(1165): n is a, c, g, or t
gnttnggctgcaagtatctcccggaattcccggggtcgacccacgcggtccggtttctttcctgagttcaatcccagttctcatttcatttcttgcttttttgggtctaattctgttcttgatttctgattcccggtgttttttcttgcttgttgttttgatatgtttccagatgccctttgaggagatgtgattccatttggaacgttgagttttgtgtcttctgccttttgcttgtttttaggagggataattttcatcagctgaaatgctttcatttacattttttctgttttcttcttatagtagctttctatggagtttggcgtttttctacttgtagacattctgtaggtgtatattttaggtcagtgagctttgctttattgattggcgacaggtatcttttcagtgggcattgtgcctcgaggtggtaggtggggtgggtttgcctttcctttggttttgcaaatgcctggattttgctcttgctggcagttgtgaggtgtgtgcggaggtctcccccatttcctgttcacgtcccccttcccatcggccgtgctgctccgacctcctctgcctcccagctccttcccctcagttgtttgagtggcccccaggatttggcctcgcagagactttctctgtctgagttttctttcgggctgtgtggcatgctctgtttggatggtgggctttagctttcttcctgccttccagactggagagcaggggctggggcccgtgtgtcctaggaatctgaaagtcgtggtcctgtgtcagttgtgtgtgtcagtcgtgtgtggtccatgttggttttggggtgttttgggaagatgtgtggagagagttggatctgtgagacccagaagcacctcgtgtttgtccctgtgtgatgcgaactgcatttcttcaacttactacttacacgtggatgctgtgggcttttgaactccagatggaatccttacctcagtaaaccaccgaagccctcttcaagcagtagaacctatctcaacgtccgtccacaaaaagcagagctttgtgctttcacccttttctactcaagaaggtangtgattcttcactttcttaaaatccttcatcaatggttgtgaaatatggtttccttatttaaagccatttctttctttttgtttctgtnttcatcagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatttctttggtattcccagtaaatacatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacacgtctaaattaaaaggaattactccaccgaaa

SEQ ID NO: 425564 - DNA, 772 bp, Homo sapiens
attggccattttggaagagaaagtgtatcagagtcaggtgagtgctcacctttgtaatttgtgaggagagattcaatgttacaattttatgttaggaaaacaacaaattaatgtttttgcagtacaaactaaagcaagctcatcctccaaaaaatttctctggctgctgagatcaagttacgaaaaaaacaaaaaagaggctgggcatgatggctcacacctgtactcccagcactttgggaggccaaggtaggaggatcacttgaggccaggagttcgagaccagcttgggcaacatagtgagacctcatctctacgaacgatataaaaggtgggtgtagtggtgcctgcgtgtagtctcagctactcaggaggccgaggcaggaggattgattgagcccgggaggtcaagctgccatgagctgtgattgcaccactgcactccaggctgggtgacagagtgagaccctgtctcaaaaagaaaaaggccatgctcagcagtgttctttcttcctggtcataggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggcaagtggggaagctctggaccagc

SEQ ID NO: 425565 - DNA, 722 bp, Homo sapiens
aagaaatagtctaccttggtgcaaaaagtaggagtcacacactaagaacttgagacagttgtacaatctaaaagaaatttctagaaatgaaactgttatctctgaaatttacaaccaagtgaatggttacatagcagattagatatagctgaagaaagaattagggaacagaaggataactctgaaaaaattatcaagagtgtagtagcagaagaaaatagaaacagagtggctaaacccacagaggaatgtgacatggcctgttatacatcgatgtattgtagtgcaaatcagtgttaataccatcattattcttaaggttggaaacagtccatctgttcattttgttactttattttttcagtctttcccataaaggtaatgaattttggggcactacacaaacactgaatgttaaatttctgccttcagatcctaatcactttattattggcacagacatggtgagtagtattttaaatttaatcctattactcattctccttgttttcctgacttacctgataaatatcttgatttaggattaacttactcttttctttataaagtttaaattgtttgaggaacagtagctgtatccaatctcgtgtgtaatgcactcgttcagtcactcttgggcttcttcttcacagggtctcataagccatggcacaagacaagatttgagagtggctcccaaactattcaaacctcagcaacat

SEQ ID NO: 425566 - DNA, 1985 bp, Homo sapiens
acaaatacataggccatataaaggaaaaaataaaactaagtatagtttttaaaaggaaaggaaaatctctaaatgccataaacaggagagagcttaaagttagtgtcataagcttttgagctgctatgtgatggcttggaggctgggtgtgaagcccaggctgtctcagaccttctgagctgtctctggggcttgagccccatgcagaaccaggcgacgcattgggtttgcctgaggcaaggaggtagaactgagacccctgcacaggactctggaactcactgctcctgcagtgatagggaaattcagaaagccgcaccacagccaagggaagacagaggagcttggaagagcttgaaatcctaagctgagtgggtgtgtgggaacccacaagctgagatgttagcatcacagttctagaccagtggcctcagtgggttcatagttaaagtagacgcaaaaccccctggtgggtaaagatatgtttgcaaattggggctcacaggtttcttatgagaagcagtctgctgcagatgagctcacaactacaagcatgaagaaatagtctaccttggtgcaaaaagtaggagtcacacactaagaacttgagacagttgtacaatctaaaagaaatttctagaaatgaaactgttatctctgaaatttacaaccaagtgaatggttacatagcagattagatatagctgaagaaagaattagggaacagaaggataactctgaaaaaattatcaagagtgtagtagcagaagaaaatagaaacagagtggctaaacccacagaggaatgtgacatggcctgttatacatcgatgtattgtagtgcaaatcagtgttaataccatcattattcttaaggttggaaacagtccatctgttcattttgttactttattttttcagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatttctttggtattcccagtaaatacatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacacgtctaaattaaaaggaattactccaccgaaa

SEQ ID NO: 425567 - DNA, 1369 bp, Homo sapiens
gtgttgcccaacagtattctagagcttcacaagtgttatctctgaaatttacaaccaagtgaatggttacatagcagattagatatagctgaagaaagaattagggaacagaaggataactctgaaaaaattatcaagagtgtagtagcagaagaaaatagaaacagagtggctaaacccacagaggaatgtgacatggcctgttatacatcgatgtattgtagtgcaaatcagtgttaataccatcattattcttaaggttggaaacagtccatctgttcattttgttactttattttttcagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatttctttggtattcccagtaaatacatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacacgtctaaattaaaaggaattactccaccgaaa

SEQ ID NO: 425568 - DNA, 588 bp, Homo sapiens
ttaatcttctatgaatgcttttcagagattaagcctttgcctgatctcagcagcaaattctaatattttggatgcaagttatttcacagaagggactctgataggaagacagaatgtgaaattaaacatctatgtcttaggtctggcagaaatagatactgttaacatcagtgtgttgggtataaaataatctctcttctggtttcaggaaagcatagagaaaaaaactaagattcttttctaatttttattgacccagctgaaatagtataatggtcttgcctttttaaggcacttaaacatttgtttagttgaattgtttgaaaggacagaggagaataggacattccatatttgaacagtataagtagaagaacatgaattgatggaggtggtagtatccttccacatttttttttctatcaggaattagactcctacagactttgtatcttaagaaagaaatgcagaatgttggtaaaatactaacagttttcaaatgatacctaatctaaatgttaattgaaatagaattcacaacaaatctgctcatgtaatcctgaatctaaaataaaagtttttaaaaaa

SEQ ID NO: 425569 - DNA, 3526 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425570 - DNA, 1629 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425571 - DNA, 4088 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425572 - DNA, 1863 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425573 - DNA, 956 bp, Homo sapiens
  misc_feature (13)..(13): n is a, c, g, or t
gattacgaatatncgagctcaggtacccccatgtcagtcgctcattggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425574 - DNA, 3505 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425575 - DNA, 4722 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425576 - DNA, 2231 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425577 - DNA, 2024 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425578 - DNA, 3561 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctgccaaaaaaaaaatattgaaatacatgttccacatc

SEQ ID NO: 425579 - DNA, 3574 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactgtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425580 - DNA, 4999 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425581 - DNA, 5082 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgaggggtgaggtggccggcctccagggctgctcagtctccctccacccccgctgcctgctcaccactggcctctgatttctcgccgtaatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425582 - DNA, 4805 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgaggggtgaggtggccggcctccagggctgctcagtctccctccacccccgctgcctgctcaccactggcctctgatttctcgccgtaatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425583 - DNA, 3803 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425584 - DNA, 3451 bp, Homo sapiens
  misc_feature (45)..(46): n is a, c, g, or t
  misc_feature (3388)..(3389): n is a, c, g, or t
  misc_feature (3420)..(3420): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagataaagatatannccagagactgtagcttgggataaatttaacnagaaacaaaaacagaacaaaaaaataaaaaa

SEQ ID NO: 425585 - DNA, 4450 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattgccaatcccacgtggccatcgggacggggggacctca

SEQ ID NO: 425586 - DNA, 4304 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagccgtgcttcctaggcccaccgggagtctggagggagggaatttgtgtaaagcgcttgagatggtgactttagtacctagtgagtgctggtgaaccccgctggtgaggctgttcaggtgactgagattctggcgcagggcaggtcagaaaggggcttgggcatgtgaaagatggcagtgcga

SEQ ID NO: 425587 - DNA, 514 bp, Homo sapiens
  misc_feature (10)..(10): n is a, c, g, or t
aacggctgcnggatcatggacaatggcttctttctccatctgtgaggtggagaaggttggactttggtgtttctgagccctccccccgatgtccaccttccagctgggccatacttgggccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425588 - DNA, 4014 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacgatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425589 - DNA, 2872 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtgggccatacttgggtaatatcccgaaactaccttaaaattaccttcgactcagtctgagtaaactgtccacgaagctgttcgtgggtggggggggcctgggtgtaggtgcttttacatgaaagcaatttcaagcattccctcaggggccgggtgcggtggctcacgcctgcaatcccagcactttgggaggccgaggcgggtggatcacctgaggtcaggagtttgagaccagcctggccaacatggtgaaaccccgtctctactaaaaatacaaaaattagccaggcatgatggccac

SEQ ID NO: 425590 - DNA, 425 bp, Homo sapiens
atgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgtgagtggtgccagcagacgcaggggaggggccggccagggcagagcgagcccggaccgctcacgggggcggacatgggagaggaacagagcaccatgtcccagaccagctggggagagagggtggctagtgtgggcgtgacttctgggggctctgtgctgtccccacggcactggatggggcactgac

SEQ ID NO: 425591 - DNA, 3133 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggtgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 425592 - DNA, 1719 bp, Homo sapiens
  misc_feature (45)..(46): n is a, c, g, or t
aaggctaggtgagaggcctgcggtgaaatcggcgaggaggccgcnnctccgcggatcgggccgctcggccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagaccctggttctgcgggggcctgctcctcctctgccacatcagggctgactcagcaccaactccgcgctctccactcctcagggacaggcgcccttgtcactcctggtttcccgggagcttgtgccacatc

SEQ ID NO: 425593 - DNA, 2380 bp, Homo sapiens
taaagcttgaacacaggaacactacaactgccagatgctgaggagaatcaggaaagcaatgagctagactctttttttagtcaattaagtgggttgttttagatgtatagagtattgatatgagttaacactttttagtagatggcaaagtgggcttgatgttcaaaagtaatgttcgagttagggttcatggtccctttctcagtaattttttcttaataaaagtaaacactggttcaaagacaaatagcaagtattccctcctgtgctatttatagagggctcaattcgtagaaaggcataccctccaatgcaattctgtggctgtcccttacagtggtttcagaatcacgaaaaaacagctagtaaataggatagaaacaataaaagaaagagtttagaagttccctgtgagcaatctgtgtgtcttcagcgagcttgaaccaaagtcttcatatcctgacccactgaattataagcaattgctacttgcccatcttgccaaagtagtccaaacacacttcaatgaggacagttatatttagcaggtcctcacccctgcaagagacagcatatcctcactattattattcatgtgttattggcaaaaacatagcttgcatctttccagaggcagagtttcaaagacagggttttctttgagacataagcacattgcttaagtacataacaaggttattaacacttgcactcaggggaaaggaaatagctattgcaaattaatgtgtgcaacttaataaaataagctgtttgtgtatatgaatttagctctaggtaagcaaaatgcacacatcatataaaaataaattgcaatgatcagaccaagtggctgtgctggacatcaaagaaaagacatgctgttgccatcaggagaactctttcttatatgcgatagccaagatatcttctttaatatgaaaaaagttaatttctgaatttcaaaaagagtaagattagctaattggtcttcctaatttttatgcctttagagtttttagtctattcaagtagaagagtccagcgaggccaaagaagggttacggtgttcaagttctggttgttggagtttttagcccagagtgacatactgaaatcagtaaataattattttataatgacacagcacaactgccttgttatgaatttttcttaaatgcatatatactgtatttaaaattaaaatatagataccaatttaccaaagatacatattactaattctaagcaaaactaaaaaaaaaacccaactcatcataatttaagaatcaaaatgtagttgtcttaagaatttagtggttatactggaaatgcattttcaactcctatgttctaaagtttatgttcaaatggtgccagtgaatttttatatgaagggaaaatgcctgctttttttttttttttaaccagatgtaatttcacttaaccctttgcgctttcccttagttgtcatttaacatacaatactggctttacttatctctagaaaagaagaaggcatgctacaaataggaaggaattgtaataatgatatttggcctctactttgtcttagctgttaaactgtttttagtatttttgttaaatatttgcaaagggaagcattttctacagaggataattaatttcaagaaaaatatcttgagttttaagaaataaacatctccagaaaaggagaaagtcgattttataaaatgtcgcaactctccaacatttggggtagtgactccttttttgttaggacatttgaaactagcaagcagccattgtttctaaagaattctggcttcacattgactcatgtttctttcactccattttgaaatagctaaaaatcattaaaactgtaaatattttgttgcttgggtaagcatcttctgggaactttgtatctatggtatataatcatagaattttatattttcatataaagctaatttttttctagtttcaactccgtcatagttttttttcctttttgtggtggatatgtgaattcaactttctgtgtattgaagtagcaaaaaccatctttacattccaaaagaatccaacatgtgttatttctttgaggcagtgattgtgaaagttgggttttctttttaattccattgaccatttgtgcaataggaattagacataattagtcactgaaaacattcgtcacattgacccatttggaaaaagtgtgctttttttttttttttaaatttgttcagggggaggggttttgtaacctgaaatttttccctttttcttctgtttaaactatatcaaatcattctattatagtgttatttaatatgtaaattgtattgctatacataaaataaagtatggtttttgatgtaaaaaaaaaaaa

SEQ ID NO: 425594 - DNA, 855 bp, Homo sapiens
taaagcttgaacacaggaacactacaactgccagatgctgaggagaatcaggaaagcaatgagctagactctttttttagtcaattaagtgggttgttttagatgtatagagtattgatatgagttaacactttttagtagatggcaaagtgggcttgatgttcaaaagtaatgttcgagttagggttcatggtccctttctcagtaattttttcttaataaaagtaaacactggttcaaagacaaatagcaagtattccctcctgtgctatttatagagggctcaattcgtagaaaggcataccctccaatgcaattctgtggctgtcccttacagtggtttcagaatcacgaaaaaacagctagtaaataggatagaaacaataaaagaaagagtttagaagttccctgtgagcaatctgtgtgtcttcagcgagcttgaaccaaagtcttcatatcctgacccactgaattataagcaattgctacttgcccatcttgccaaagtagtccaaacacacttcaatgaggacagttatatttagcaggtcctcacccctgcaagagacagcatatcctcactattattattcatgtgttattggcaaaaacatagcttgcatctttccagaggcagagtttcaaagacagggttttctttgagacataagcacattgcttaagtacataacaaggtcataacctggcctccgggaacggactactttggcagtaatggtggacttcaaaaaagcgtgcggtataactagactgggtcacatgccacccttaatttgcggtacaccatgtcggggtccaacaagttgccccaccatttaccactattctcgtcgt

SEQ ID NO: 425595 - DNA, 2104 bp, Homo sapiens
agggagtaaggaataaaagatatagaatagtaatctagttgaactgttctgcacaaaacatgcttccttttcaaagaatagacttcaaaagggacgaacaaacattaggtcaccttttgtgtttataatgaattgttgacgtttccatgctgtggtctcttgatatacggaagtagacgtaacttattttccagcgaaattatatacttcttctgggctcctttgctcagttgccccaggaaggcttccctgtgagtaatgcttatggaatctgacaaatgtgaatgagctgccattggtgggaatcagtaaactttgaaaacctttcactgatgattccctggtaagtgctcctgtgaggggccacttccctagtatgtgagagagaccctctgcaagccgctgtggggacttagcttcctgatactaggtagtgatggtggatctagagacattcacttgaagagcaaggattggggtggggtgggttggtgaatctatctcaggccactgcactgcaaggtgcatttctgtcatttctgcaacaccatgagacctgagcaagaatgtgctgtggcagagggggtcttggtttcataaatgggtatatacagcctgaactcaggaggcagaaatcaaaagaaatccttgagggctggaacctgaggatagagcgaaaatggagagaagggtgttcaaggtcaggagtgatttttgcatttggtggaaaacctcaagtcagactcagtggcagaacatgcagcagaaaagctgtgaaggaaggaaatttacgtgattgtaatggaggctaggggtggattgggaggtgagtggaggagagtctctgaccagctgcagagccaacccctatcattttattaacatggaacccacacagataggggagggattaagctaagaacttacagaatgcaaacacgagcacactctcttcgaacccaattgtgggtgtagcaatgaaagcaatatgatatgctgcagtgtgaagctccttctggggttatcgtatgtacaaagtttaccttataatggctcaaattgtatttaatttttttgttttgtttataaatgaagaaaagctataagtataatgtaattattttataggtatactattaaattatagaacaaataaagataatctaggattatatgtgatcccggtgtgacgtgccataaaagtggaatttttgacttgttgcagtgagctgtgaagcagcactatgcgttcagagagtttttgttcaaccatggtgagttcaacctctagcttatgtcacatgatctcctttggggtctggaatcttctaagagaaatagaatcaggcatccaaggagcagaagtgatggaggtggccctcaatcctggtctttggaagcttccaagcctcttccacatcccctgccagctgaagacagagtattctcactgtgctggctgaaggagaaacactaaacaaggaaaccttgagaaactgcagcaatggaagtccactgttagtctctccgttagcaccagggacacacttgttctgagttttgttcattttcacatttactcctcatgagttccaacatttcttaatttaaatatttcttagtttatagcatctccatttttctattaattgacttaatctgccatttaagaaaactccgtaatcaataaaaaataaaatccacaatcaaactgcacatggttgatccactgtgtaggcttcaaaggaattaaactcaacttcctaggaaataattcatcttagtttattaaatgggacagaatatttcactgctaacgtattctaactcacttgtttttgaaattggccagatgatttttaagttataaagtcaatgaaaatgacttttgctattgtgtgaacaacttagaatgtatatattcccagaaggcttatttaatgattgacctatcaccactgattattaatgtctgcatgaatgataacaataagaccaagtcatcaataatgcaatgaaaattttttaagtgaaagcaagtttattaagaaagtaaaggaataaagaatgcctacttcataggcagagcagcctaaaaaaaaaa

SEQ ID NO: 425596 - DNA, 1034 bp, Homo sapiens
tatgacgcacccacgcgtccggaagaaaagctataagtataatgtaattattttataggtatactattaaattatagaacaaataaagataatctaggattatatgtgatcccggtgtgacgtgccataaaagtggaatttttgacttgttgcagtgagctgtgaagcagcactatgcgttcagagagtttttgttcaaccatggtgagttcaacctctagcttatgtcacatgatctcctttggggtctggaatcttctaagagaaatagaatcaggcatccaaggagcagaagtgatggaggtggccctcaatcctggtctttggaagcttccaagcctcttccacatcccctgccagctgaagacagagtattctcactgtgctggctgaaggagaaacactaaacaaggaaaccttgagaaactgcagcaatggaagtccactgttagtctctccgttagcaccagggacacacttgttctgagttttgttcattttcacatttactcctcatgagttccaacatttcttaatttaaatatttcttagtttatagcatctccatttttctattaattgacttaatctgccatttaagaaaactccgtaatcaataaaaaataaaatccacaatcaaactgcacatggttgatccactgtgtaggcttcaaaggaattaaactcaacttcctaggaaataattcatcttagtttattaaatgggacagaatatttcactgctaacgtattctaactcacttgtttttgaaattggccagatgatttttaagttataaagtcaatgaaaatgacttttgctattgtgtgaacaacttagaatgtatatattcccagaaggcttatttaatgattgacctatcaccactgattattaatgtctgcatgaatgataacaataagaccaagtcatcaataatgcaatgaaaattttttaagtgaaagcaagtttattaagaaagtaaaggaataaagaatgcctacttcataggcagagcagcctaaaaaaaaaa

SEQ ID NO: 425597 - DNA, 6490 bp, Homo sapiens
tgcgagcccagcgtcaagtgattccggcctcctcgagacagcggtggtgggatgaggctctgccgaggggactggctgtgaaggatgagttcagggtgggatgacggaccgcttctgggaccagtggtatctctggtatctccgcttgctccggctgctggatcgaggggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagcaggctgttga

SEQ ID NO: 425598 - DNA, 3470 bp, Homo sapiens
  misc_feature (1996)..(1997): n is a, c, g, or t
  misc_feature (1999)..(2002): n is a, c, g, or t
  misc_feature (2074)..(2074): n is a, c, g, or t
  misc_feature (2088)..(2088): n is a, c, g, or t
  misc_feature (2242)..(2242): n is a, c, g, or t
ttggaattggagtctccatgaaccagtggtgacttccagagctctgctccttctagattccttcagagttcttgagcctcctaaaaagtataaggaggagccaggtgccatggctcatgcctgtaatcctagcactttgggaggccaaggtgggcagattgcttgagcccagtagtttgagaccagcctgggcaacatagtgagacctcatgtttacaaaaaatgcacaaagttacctgggtgtggcggtgggcacctgtagtcccagctactcaggaggctgagatggaaggactgcttgagcctgggaggtggagactgcggtgagctatgatcatgccactgcactgcagcctaggcaacagagtgagactctgtctcaaaaaagaaaaaaaaaaaagcaaaagaaaatatggaaggaaggagggtatgccttctccattgtcttggattccatacacctgctgggacaggggcctcacagctttgtctttcgcaggcctgcaccctggctcggcggaatgctgaggtgtttctcaagtacatccacaggaacaacgtcagcatgcccagtgtcgccagccacactcggggacccgagcaacaagtgaaaggtcagtgagagacctgcccagccaccagtcacttcagcgacagcccctccctgaaatataccatgtacccagttttcacacaatctcaaatttcctgctgcttctccttagaaatgaaaatgtatgatgtgggatggtgtgggcagtaatgattcatggtcaatttttaaacacgcatcaagatctggaaggcaaaaacaaggataaaatttccccaagtattttcatttatcttagagtctggacagcactgcctagtggaattttctgaaataatggaaattgcctgtatctacgctgtgcaatacagcagctactgagctagtgcaactaaggaactaaattttaacttgtatttaatattaactaatttaaatgtaaattactgattttgattcctggttaatatattgaacagcacaagactagggtgtcttatagcctaggaacagaatgtggactgagaatcctaaaaccaaatgctgaccctggatttgtcactgattgattaagccttttaaaactttagtttcttatttaaaatgaggggagcatctagactcttgctcctcaaattgtagttcccagaccagccacaatgacatccctaggagagtgtatgaaatatagaatctcaggccacacccaaaccgactgagtcagaaactgcattttggcactttgggaggctgagatgggagggttgcttgaggccaggagttcaagaccagcctgggcaacatattgagaccccatctctacaaaaaattaaaaaattagcctggtatggtggcgtgcctatagctctagttattcaggaggccgagatggaaggctcatttgagcccaagagctggaggctgcagtgagccatgtttgcaccattgtactccagcctgggcaatagagtgagacgctgtctcaaaaaaagaaaaaagaaaagaaaaaaaagaaaaaaagaacaaagaacctgcattttggcaaaactgcccaattctaccaaccaggtaatttgtgtgttcataaaatttagataagtgctattctacataatctttaatatctccgaattctagaaagtctatgataataaatatataacttttaaaaattgcctattatctgaccatgtgaaacttaaatcattatctgtggaattattctgaccatgcagaaattagcctttgagtgagtgaagagtttaacaaatgtcatcttgccaaggcagagaaatataactctggagtccgaggctaggaatggaacccaagccgacttggagtgaggagtggggtatgggcttggagacaccatggacagggtagggtgcgtggtctgcttaagaagagcttccctctttgctcagatagctcaagagttgnngnnnncagagaccactggaaagaatggaatcaaagttccctacagagaggagggagcagagtttctcttccaaatgngctattctatttgnggtcaggggacctgtggggagctggtattatgtcacttcttccagcacatttgaaagcatatgttctggcttccaaatgtagatgggagcttgggtgaggccagctgcctactgagagaccacatatcccacctacacctctgcgtgctgaagnataacaggcacccagagacagtgggaaatgcctacatcttcttggaggcaagaccaagttgttgcccatgtaaaagctttcaggaagaggggggaaaataatcctgaaactctttatgatttctgccagatctgggttgattccctcagtcacaccatagagggagggagcttcaatgagcaaaactctggctagggaacataaagactaaaagaaatgggtttctactccttccttgcccaattgaagcttccacctgagcagggacctacaatcccttatatatcagtttccttttcacctactacctagactcaaagccagtgccatatatttttggcttttttatgctgctggttgttatatggctgcataacaaccaagaaattcaatgatatccaactgtaaacatatgttgttgaagtggctgtgcattggctgaggagcagcatctcaactgggctcagcagtgcagttgtgcttcagtctgcaagtctagctagcttggctccttcactccaggtaagagcttgtttgctccacgtgtatttattctgggacctgggtcgaaggggcagcagttacccaggagaatttcctatagtggtgatagcagaggtacaaggagcaaagtcaagtctgcaagtacatttcaaggccctgcttgtgttttatctgttaacaactcatttgctaaagcaagttatgtagctaagccagagatcagttggggagtgagcaactgtacttgcctctttgggaaggaatgaaaaagttacatgataaaggcttagatacagggaagggtgaatgattggacccaaaaaaggctgagcacggtggctcgcgcctgtaatcctagcactttgggagaccgaggaaggaggatcacttgagctcagaagtttgagaccagcctgggcaacatagtgagacccccatctctacaaaaaaaaaaaaatgtttacaaattgactgggtgtggtggcgtgtgcctatagtctcagctactcaggtggctgaagtgggaggatcacttgagcctgggaggttgaggctgcaatgagctatgactgcactccatcttgggtgacagagcaagaccctgtcaaaaaaaaaaaaaaagaacaagaaaaagaaagaaagaaagagagagaaagaaaaaaaagcacttagcctaaaagatgaaaaacagattctgtcctcagaaagccaaacttggctgggg

SEQ ID NO: 425599 - DNA, 642 bp, Homo sapiens
  misc_feature (1)..(1): n is a, c, g, or t
ngcgccatgccagcccatgagttagggaaggacgtctcaaagaggttgtcctcgtgccgaatttggcacgaggttgataattgttgaaactagatgatggtcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagcaggctgttga

SEQ ID NO: 425600 - DNA, 807 bp, Homo sapiens
tgcgagcccagcgtcaagtgattccggcctcctcgagacagcggtggtgggatgaggctctgccgaggggactggctgtgaaggatgagttcagggtgggatgacggaccgcttctgggaccagtggtatctctggtatctccgcttgctccggctgctggatcgagttccatctatgttgctgcaaatgacaggatttcctttttataggttgtctcttcactctgttgattgtttcccttgctgtgcagaagctttttagtttcaacaagggtgccaagaacatatattgggaaaaggacatccttttcaataagtggtgctgggaaaatgggatatctatattcagaagaatgaaattagacccctatctctcaccctatacaaaaatcagctcaaaatggattaaagacttacgtgttagaagacaggtcccagtcttcctaatgaggcattgaaagtctaggtggaatagatgcttgctggagcctgtggatattataaaagaaagagctcactgccttaatgtggtcaggagaggcaggagtgagagccagtgtgaaggtgtgggagttggaaggaacttggaactcaacttcttttggcccctcaacttgagattcacaaagaaaaaaagcaatgtctcctcgctgaaagcaaaatggaagctcctccttgcacagtgcagccccttcctcactgtaggttattccaagtgagaagagtaaacatgacttctaaatgccatctaacgatatatgcatatctaaaggagacaaggatgactgaatgcatcttcatgtgtag

SEQ ID NO: 425601 - DNA, 395 bp, Homo sapiens
cggccgcagcagctgcgccccgcgccctccgcccaccgggcgccgagcagccctcggccccaggcttcttcggctcccggctgcccgcggacgccctcccacagtcatgaacccccctgagggagcagcggaggaaggaggagcagcagactcggacgtggacgcctttttccggacgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaaggtaaggggaaggggaatggcctg

SEQ ID NO: 425602 - DNA, 6473 bp, Homo sapiens
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagcaggctgttga

SEQ ID NO: 425603 - DNA, 6438 bp, Homo sapiens
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagcaggctgttga

SEQ ID NO: 425604 - DNA, 5445 bp, Homo sapiens
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactgggtcttttcggaatgatggtttgaaagcttctgatgtccttcctatcctaaaggaaaaggtggccttcgtgtctggtgaggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcacgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagctttgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaagctctctggtggatgtgagctgacagtggtcctccaggacttcagtgcgggccacagcagtgagctgaccatccaggtggggcagacggtagagctgctggagcggcccagcgagcggcctggttggtgtctggtccgtaccaccgaacggagcccgcccttggagggtctggtccccagcagcgccctgtgcatctcacactcccgaagcagcgtggagatggactgcttcttccccttggtgaaagatgcatactctcattcctcaagcgagaatggaggcaagtccgagtccgtagccaacctgcaggcccagccctccctgaactccatccacagttccccgggtcccaagcgctccaccaacactcttaagaagtggctgacgagtcctgtgcgtcggctcaacagcgggaaggcagatggaaacatc

SEQ ID NO: 425605 - DNA, 3451 bp, Homo sapiens
ctaatgaaaaatgtcatatgtgtaggcttctataggctgaaggtcctcagagaataattcctgaataattaatttactgagtcttttcttccatgattcactaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagcaggctgttga
